United States Patent
Kruidenier et al.

(10) Patent No.: US 11,136,386 B2
(45) Date of Patent: *Oct. 5, 2021

(54) METHODS OF TREATING CROHN'S DISEASE OR ULCERATIVE COLITIS BY ADMINISTERING INHIBITORS OF TUMOR NECROSIS FACTOR-LIKE CYTOKINE 1A (TL1A)

(71) Applicants: PROMETHEUS BIOSCIENCES, INC., San Diego, CA (US); CEDARS-SINAI MEDICAL CENTER, Los Angeles, CA (US)

(72) Inventors: Laurens Kruidenier, San Diego, CA (US); Mahyar Sabripour, San Diego, CA (US); Janine Bilsborough, Los Angeles, CA (US); Dermot P. McGovern, Los Angeles, CA (US); Dalin Li, Los Angeles, CA (US)

(73) Assignees: PROMETHEUS BIOSCIENCES, INC., San Diego, CA (US); CEDARS-SINAI MEDICAL CENTER, Los Angeles, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/118,441

(22) Filed: Dec. 10, 2020

(65) Prior Publication Data

US 2021/0101988 A1    Apr. 8, 2021

Related U.S. Application Data

(63) Continuation of application No. PCT/US2020/032679, filed on May 13, 2020.

(60) Provisional application No. 62/847,798, filed on May 14, 2019.

(51) Int. Cl.
| | |
|---|---|
| *C12Q 1/6883* | (2018.01) |
| *A61P 1/00* | (2006.01) |
| *C07K 16/28* | (2006.01) |
| *C07K 16/24* | (2006.01) |
| *A61P 1/04* | (2006.01) |
| *A61K 39/00* | (2006.01) |

(52) U.S. Cl.
CPC .......... *C07K 16/241* (2013.01); *A61P 1/00* (2018.01); *A61P 1/04* (2018.01); *C07K 16/2875* (2013.01); *C12Q 1/6883* (2013.01); *A61K 2039/505* (2013.01); *C12Q 2600/106* (2013.01); *C12Q 2600/156* (2013.01)

(58) Field of Classification Search
CPC .. C07K 16/2875; A61P 1/00; A61K 2039/505
See application file for complete search history.

(56) References Cited

U.S. PATENT DOCUMENTS

| | | |
|---|---|---|
| 4,229,447 A | 10/1980 | Porter |
| 4,476,116 A | 10/1984 | Anik |
| 4,596,795 A | 6/1986 | Pitha |
| 4,755,386 A | 7/1988 | Hsiao et al. |
| 5,011,692 A | 4/1991 | Fujioka et al. |
| 5,017,381 A | 5/1991 | Maruyama et al. |
| 5,116,817 A | 5/1992 | Anik |
| 5,229,135 A | 7/1993 | Philippon et al. |
| 5,739,136 A | 4/1998 | Ellinwood, Jr. et al. |
| 5,739,163 A | 4/1998 | Cain et al. |
| 5,837,284 A | 11/1998 | Mehta et al. |
| 5,840,329 A | 11/1998 | Bai |
| 5,858,401 A | 1/1999 | Bhalani et al. |
| 6,391,452 B1 | 5/2002 | Antonsen et al. |
| 6,667,048 B1 | 12/2003 | Lambert et al. |
| 6,960,563 B2 | 11/2005 | Egbaria et al. |
| 8,301,232 B2 | 10/2012 | Albert et al. |
| 9,732,385 B2 | 8/2017 | Barken et al. |
| 9,784,748 B2 | 10/2017 | Wang et al. |
| 10,086,072 B2 | 10/2018 | Singh et al. |
| 10,261,098 B2 | 4/2019 | Bielekova et al. |
| 10,322,174 B2 | 6/2019 | Bilsborough et al. |
| 10,349,888 B2 | 7/2019 | Muniz |
| 10,385,398 B2 | 8/2019 | Hakonarson et al. |
| 10,407,725 B2 | 9/2019 | Hakonarson et al. |
| 10,458,996 B1 | 10/2019 | Kokkotou |
| 10,477,354 B2 | 11/2019 | Patel et al. |
| 10,626,180 B2 | 4/2020 | McGovern et al. |
| 10,635,787 B2 | 4/2020 | Hanusiak et al. |
| 10,689,439 B2 | 6/2020 | Watkins et al. |
| 10,877,049 B2 | 12/2020 | Bielekova et al. |
| 2003/0198640 A1 | 10/2003 | Yu et al. |
| 2009/0317388 A1 | 12/2009 | Burkly et al. |

(Continued)

FOREIGN PATENT DOCUMENTS

| | | |
|---|---|---|
| WO | WO-2008106451 A2 | 9/2008 |
| WO | WO-2008107389 A1 | 9/2008 |

(Continued)

OTHER PUBLICATIONS

Altschul et al.: Basic local alignment search tool, J mol. Boil, 1990, 215:403-410.

(Continued)

*Primary Examiner* — Robert S Landsman
(74) *Attorney, Agent, or Firm* — Wilson Sonsini Goodrich & Rosati

(57) ABSTRACT

Provided are methods, systems, and kits for selecting a patient for treatment with a therapeutic agent based on a presence of a genotype associated with a positive therapeutic response to the therapeutic agent. The therapeutic agent, in some embodiments, is an inhibitor of TL1A activity or expression, such as for example, an anti-TL1A antibody.

53 Claims, 8 Drawing Sheets

Specification includes a Sequence Listing.

(56) References Cited

U.S. PATENT DOCUMENTS

| | | |
|---|---|---|
| 2010/0136543 A1 | 6/2010 | Georges et al. |
| 2011/0160085 A1 | 6/2011 | Li et al. |
| 2015/0301055 A1 | 10/2015 | Spetzler |
| 2016/0215046 A1 | 7/2016 | Michelsen et al. |
| 2017/0051351 A1 | 2/2017 | Hakonarson et al. |
| 2017/0051352 A1 | 2/2017 | Hakonarson et al. |
| 2017/0166967 A1 | 6/2017 | Rotter et al. |
| 2017/0185737 A1 | 6/2017 | Kovacs |
| 2017/0242043 A1 | 8/2017 | Bielekova et al. |
| 2018/0230543 A1 | 8/2018 | McGovern |
| 2019/0194754 A1 | 6/2019 | McGovern et al. |
| 2019/0265254 A1 | 8/2019 | Bielekova et al. |
| 2020/0080152 A1 | 3/2020 | Hakonarson et al. |
| 2020/0318066 A1 | 10/2020 | Sharei et al. |
| 2021/0001849 A1 | 1/2021 | Miura |
| 2021/0038709 A1 | 2/2021 | Loughhead et al. |

FOREIGN PATENT DOCUMENTS

| | | |
|---|---|---|
| WO | WO-2013074676 A2 | 5/2013 |
| WO | WO-2014186750 A2 | 11/2014 |
| WO | WO-2015136446 A1 | 9/2015 |
| WO | WO-2016028699 A2 | 2/2016 |
| WO | WO-2016028699 A3 | 4/2016 |
| WO | WO-2016028699 A8 | 11/2016 |
| WO | WO-2017035010 A1 | 3/2017 |
| WO | WO-2017035017 A1 | 3/2017 |
| WO | WO-2018081074 A1 | 5/2018 |
| WO | WO-2019178005 A2 | 9/2019 |
| WO | WO-2019178005 A3 | 10/2019 |
| WO | WO-2019209995 A2 | 10/2019 |
| WO | WO-2020112890 A1 | 6/2020 |
| WO | WO-2020176789 A1 | 9/2020 |
| WO | WO-2020232125 A1 | 11/2020 |
| WO | WO-2020242976 A1 | 12/2020 |
| WO | WO-2021016090 A1 | 1/2021 |

OTHER PUBLICATIONS

Altschul et al.: Gapped BLAST and PSI-BLAST: a new generation of protein database search programs. Nucleic Acids Res. 25:3389-3402 (1997).

Barrett et al.: Constitutive TL1A Expression under Colitogenic Condition Modulates the Severity and Location of Gut Mucosal Inflammation and Induces Fibrostenosis, American Journal of Pathology, 180(2):636-649 (2012).

Behravan et al.: Machine learning identifies interacting genetic variants contributing to breast cancer risk: A case study in Finnish cases and controls. Sci Rep. 8:13149 (2018).

Breuer et al.: Detecting significant genotype-phenotype association rules in bipolar disorder: market research meets complex genetics. International Journal of Bipolar Disorders. 6(24):10 pages (2018).

Chatterjee et al.: Developing and evaluating polygenic risk prediction models for stratified disease prevention.Nature Reviews, Genetics. pp. 1-15 (2016).

Choi et al.: A guide to performing Polygenic Risk Score analyses. bioRxiv. 22 pages (2018) http://dx.doi.org/10.1101/416545.

DbSNP Short Genetic Variations Submitted SNP(ss). Details: ss112518351 Mar. 29, 2020 [online]. Retrieved Oct. 5, 2020 URL:https://www.ncbi.nim.nih.gov/projects/SNP/snp_ss.cgi?subsnp_id=ss112518351.

DbSNP Short Genetic Variations Submitted SNP(ss). Details: ss226749241. Jul. 20, 2011 [online] Retrieved Oct. 5, 2020. URL:https://www.ncbi.nlm.nih.gov/projects/SNP/snp_ss.cgi?subsnp_id=ss226749241dbSNP.

De Lange et al.: Genome-wide association study implicates immune activation of multiple integrin genes in inflammatory bowel disease. Nat Genet.: 49(2):256-261 (2017).

Ellinghaus et al.: Analysis of five chronic inflammatory diseases identifies 27 new associations and highlights disease-specific patterns at shared loci. Nat. Genet. 48(5):510-518 (2016).

Golumbeanu et al.: Clustering time series gene expression data with TMixClusT. Department of Biosystems Science and Engineering, ETH Zuerich, Switzerland. 16 pages (2018).

Huang et al.: Fine-mapping inflammatory bowel disease loci to single-variant resolution. Nature. 547(7662):173-178 (2017).

Jostins et al.: Host-microbe interactions have shaped the genetic architecture of inflammatory bowel disease. Nature; 491/7422:119-124 (2012).

Landers et al.: Selected loss of tolerance evidenced by Crohn's disease-associated immune responses to auto- and microbial antigens; Gastroenterology; 123:689-699 (2002).

Li et al.: Late-Onset Crohn's Disease is a Subgroup Distinct in Genetic and Behavioral Risk Factors with UC-Like Characteristics. Inflamm Bowel Dis. 12;24(11):2413-2422(2018).

Liu et al.: Association analyses identify 38 susceptibility loci for inflammatory bowel disease and highlight shared genetic risk across populations; Nature Genetics; 47, 979-986 (2015).

Machiela et al.: LDlink: a web-based application for exploring population-specific haplotype structure and linking correlated alleles of possible functional variants. Bioinformatics. 31(21):3555-3557 (2015).

Medrano et al. Role of TNFRSF1B polymorphisms in the response of Crohn's disease patients to infliximab. Human Immunology 75(1):71-75 (2014).

NCBI dbSNP Short Genetic Variations Reference SNP (rs) Report for rs1892231. Jan. 25, 2009 submission. [online] Retrieved Oct. 5, 2020. URL:https://www.ncbi.nlm.nih.gov/snp/rs1892231#submissions.

NCBI dbSNP Short Genetic Variations Reference SNP (rs) Report for rs56124762. Jan. 25, 2009 submission [online] Retrieved Oct. 5, 2020 URL:https://www.ncbi.nlm.nih.gov/snp/rs56124762#submissions.

OLLECH: Efficacy and safety of induction therapy with calcineurin inhibitors followed by maintenance therapy with vedolizumab in severe ulcerative colitis: a large patient cohort with long-term follow-up. Abstracts of the 15th Congress of ECCO. S401 (Jan. 5, 2020).

PCT/US2020/032679 International Search Report and Written Opinion dated Oct. 22, 2020.

PCT/US2020/032679 Invitation to Pay Additional Fees dated Aug. 24, 2020.

Pierik et al. Tumour Necrosis Factor-a Receptor 1 and 2 Polymorphisms in Inflammatory Bowel Disease and their Association with Response to Infliximab. Alimentary Pharmacology & Therapeutics 20(3):303-310 (2004).

Remington: The Science and Practice of Pharmacy. 21st Edition, Lippincott Williams & Wilkins (2005).

Saxon et al., A distinct subset of antineutrophil cytoplasmic antibodies is associated with inflammatory bowel disease. J Allergy Clin. Immunol. 86:202-210 (1990).

Singh et al. Encyclopedia of Pharmaceutical Technology 2nd Ed. pp. 754-757 (2002).

Torkamani et al.: The personal and clinical utility of polygenic risk scores. Nature Reviews, Genetics. 10 pages (2018).

Yamazaki et al., Single nucleotide polymorphisms in TNFSF15 confers susceptibility to Crohn's disease. Hum Mol Genet 14:3499-3506 (2005).

Prometheus Biosciences, Inc. Form S-1 Registration Statement as filed with the Securities and Exchange Commission on Feb. 19, 2021 (246 pages).

Herro et al.: TL1A Promotes Lung Tissue Fibrosis and Airway Remodeling.J Immunol. 205(9):2414-2422 (2020) doi: 10.4049/jimmunol.2000665. Epub Sep. 21, 2020.

Shih et al: Reversal of Murine Colitis and Fibrosis by Neutralizing TL1A Antibody: Potential Novel Therapy to Alter Natural History of Crohn's Disease. Gastroenterology 142(5): s84 (2012).

Safety, Efficacy, and Tolerability Study of PF-0648064 in Subjects with Moderate to Sever$^e$ Ulcerative Colitis. Phase II for PF-06480605 (Pfizer, https://clinicaltrials.gov/ct2/show/NCT02840721).

Yu et al.: Downregulation of VEGF and upregulation of TL1A expression induce HUVEC apoptosis in response to high glucose stimuli. Mol Med Rep. 13(4):3265-72 (2016) doi: 10.3892/mmr.2016.4924. Epub Feb. 22, 2016.

Co-pending U.S. Application No. 202117392098, inventor McGovern; Dermot P., filed on Aug. 2, 2021.

METHODS OF TREATING CROHN'S DISEASE OR ULCERATIVE COLITIS BY ADMINISTERING INHIBITORS OF TUMOR NECROSIS FACTOR-LIKE CYTOKINE 1A (TL1A)

CROSS-REFERENCE

This is a continuation of International Application No. PCT/US2020/032679 filed May 13, 2020 which claims the benefit of U.S. Patent Application No. 62/847,798, filed May 14, 2019, each of which is hereby incorporated by reference in its entirety.

SEQUENCE LISTING

The instant application contains a Sequence Listing which has been submitted electronically in ASCII format and is hereby incorporated by reference in its entirety. Said ASCII copy, created on Dec. 9, 2020, is named 56884-761_301_SL.txt and is 14,467,905 bytes in size.

BACKGROUND

Inflammatory disease, fibrostenotic disease, and fibrotic disease pose a significant health burden worldwide due to the vast number of individuals affected and heterogeneous disease pathogenesis and varied clinical manifestations. One such disease is inflammatory bowel disease (IBD), which has two common forms, Crohn's disease (CD) and ulcerative colitis (UC). IBD is the chronic, relapsing inflammatory disorders of the gastrointestinal tract. Incidences of IBD are prevalent, affecting nearly three million individuals in the United States alone.

Few treatment options are available to patients that suffer from inflammatory disease, fibrostenotic disease, and fibrotic disease. Existing anti-inflammatory therapy such as steroids and tumor necrosis factor (TNF) inhibitors are typically used as a first line treatment for treating IBD. Unfortunately, a significant number of patients experience a lack of response or a loss of response to existing anti-inflammatory therapies, especially TNF inhibitors. While the patient is treated with an anti-inflammatory therapy that is ineffective, the disease worsens. Surgery, in the form of structureplasty (reshaping of the intestine) or resection (removal of the intestine), is the only treatment option for patients that do not respond to first line therapies. Surgical treatments for IBD are invasive, causing post-operative risks for an estimated third of patients undergoing surgery, such as anastomotic leak, infection, and bleeding.

The pathogenesis of inflammatory disease, fibrostenotic disease, and fibrotic disease, like IBD, is thought to involve an uncontrolled immune response that may be triggered by certain environmental factors in a genetically susceptible individual. The heterogeneity of disease pathogenesis and clinical course, combined with the variable response to treatment and its associated side effects, suggests a personalized medicine approach to treating these diseases is the best treatment strategy. Yet there are very few personalized therapies available to patients. Accordingly, there is a need to identify targeted therapeutic approaches for the treatment of inflammatory disease, fibrostenotic disease, and fibrotic disease and subclinical phenotypes thereof, and an even greater need to develop reliable methodology to identifying patients who, based on their genotype, may respond to any given therapeutic approach. The needed methodologies would also identify subjects not yet diagnosed who are at risk of developing the disease, for which preventative interventions could be prescribed to reduce the growing health burden.

Genome Wide Association Studies (GWAS) have provided researchers the ability to identify genetic variants (e.g., polymorphisms) that are significantly associated with IBD and subclinical phenotypes of IBD. GWAS compare the allele frequency in a given population of a particular genetic variant between unrelated cases and controls, each case representing an affected individual (e.g., patient with IBD) and each control representing an individual without IBD. GWAS, the Immunochip, and their meta-analysis have enabled the discovery of over 200 polymorphisms associated with IBD, including CD and UC.

The first GWAS on IBD identified TNFSF15 as an IBD locus containing several polymorphisms associated with IBD. TNFSF15 protein, also known as TL1A, is a proinflammatory molecule which stimulates proliferation and effector functions of CD8 (+) cytotoxic T cells as well as Th1, Th2, and Th17 cells in the presence of TCR stimulation. TL1A is believed to be involved in the pathogenesis of IBD by bridging the innate and adaptive immune response, modulating adaptive immunity by augmenting Th1, Th2, and Th17 effector cell function, and T-cell accumulation and immunopathology of inflamed tissue. Studies have demonstrated that patients with IBD who carry certain risk alleles at the TNFSF15 locus show an increase in TNFSF15 (TL1A) expression and are more likely to develop severe forms of IBD, as compared to individuals who do not carry the risk alleles. These findings suggest that inhibiting TL1A expression and/or activity may be a promising therapeutic strategy in a variety of T cell-dependent autoimmune diseases, including IBD. These findings also suggest that certain TNFSF15 genotypes in patients that confer a risk of increased TL1A expression and/or severe forms of disease may prove useful in the prognosis, diagnosis and treatment of these individuals.

Identifying potential therapeutic targets for the treatment of disease and methods of selecting patients for treatment on the basis of GWAS alone suffer from significant drawbacks. For example, GWAS relies on linear polymorphism-polymorphism associations between known risk loci and phenotypic traits, which fail to capture high-dimensional non-linear polymorphism interactions, such as the types of relationships reflective of unknown biology. In addition, individual polymorphisms identified using GWAS often have small effect sizes in a given population. Thus, polymorphisms identified by GWAS are of limited use in predicting a susceptibility to complex diseases, such as IBD (e.g., CD, UC). Further, GWAS fail to convey or account for the biological mechanisms underlying the genetic associations between a genetic variant and a phenotypic outcome (e.g., IBD), rendering them of limited use in identifying therapeutic targets.

SUMMARY

Provided herein are genotypes associated with, and therefore predictive of, a positive therapeutic response of a subject or patient to an inhibitor of TL1A activity or expression (e.g., anti-TL1A antibody) that have been identified using a machine-learning based approach. The machine-learning based approach described herein enables the identification of combinations of polymorphisms with linear and non-linear interactions that more accurately predict phenotypes of complex disease, such as IBD, as compared to traditional GWAS alone. The genotypes described herein are associated with an increase in a level of TNFSF15 (TL1A) protein expression in a sample obtained from a subject or patient, as compared to a reference level of TNFSF15 (TL1A) protein expression (e.g., derived from a normal individual). The genotypes disclosed herein are located at gene or genetic loci that are involved either directly or indirectly with TL1A-mediated or T-cell dependent inflammatory pathways. In addition, some of the genotypes provided herein are also significantly associated with inflammatory bowel disease (IBD), such as Crohn's disease (CD). The genotypes are useful for selecting a patient or a subject for treatment with an inhibitor of TL1A activity or expression. The patient may be diagnosed with IBD, CD, or both. The subject may be suspected of having IBD, CD, or both.

Non-limiting practical applications of the associations between the genotypes described herein and incidences of clinical and subclinical phenotypes in certain populations of individuals are provided herein. For example, some genotypes of the present disclosure can be used to predict a risk that a subject will develop a TL1A-mediated inflammatory disease, fibrostenotic disease, or a fibrotic disease. The genotypes are also useful to predict whether a patient diagnosed with some form of an inflammatory, fibrotic or fibrostenotic disease will develop a severe form of the disease, such as a subclinical phenotype thereof.

Further practical applications of the associations between the genotypes described herein include, without limitation, methods, systems, and kits for selecting a patient diagnosed with IBD or a subject suspected of having IBD for treatment with an inhibitor of TL1A activity or expression, provided the patient or the subject is a carrier of the genotype described herein. In addition, or alternatively, practical applications of the associations between the genotypes disclosed herein and a variation in an expression of TNFSF15 (TL1A) are provided herein. In some cases, the genotypes can be used to identify a patient who may be suitable for treatment with a targeted TL1A therapy (e.g., a patient carrying a genotype associated with an increase in TL1A may be suitable for a treatment with an anti-TL1A therapy). An exemplary condition includes Crohn's disease (CD). An exemplary inhibitor of TL1A activity or expression is an anti-TL1A antibody. In some instances, the anti-TL1A antibody is a neutralizing anti-TL1A antibody.

Aspects disclosed herein provide methods of treating an inflammatory, a fibrotic, or a fibrostenotic disease or condition in a subject, the method comprising administering to the subject a therapeutically effective amount of an inhibitor of Tumor necrosis factor-like cytokine 1A (TL1A) activity or expression, provided a presence of at least three polymorphisms is detected in a sample obtained from the subject, wherein the at least three polymorphisms are predictive that the subject will therapeutically respond to the inhibitor of TL1A at a positive predictive value of at least about 70%. In some embodiments, the at least three polymorphisms comprises rs1892231, rs56124762, rs6478109, rs2070558, rs2070561, rs11897732, rs6740739, rs17796285, rs7935393, rs12934476, rs12457255, rs2070557, rs4246905, rs10974900, rs12434976, rs16901748, rs2815844, rs889702, rs2409750, rs1541020, rs4942248, rs12934476, rs12457255, rs2297437, rs41309367, rs10733509, rs10750376, rs10932456, rs1326860, rs1528663, rs951279, rs9806914, rs7935393, rs1690492, rs420726, rs7759385, rs10974900, rs1326860, rs2548147, rs2815844, rs889702, rs9806914, rs7278257, or rs11221332, or a proxy polymorphism in linkage disequilibrium therewith as determined with an $R^2$ of at least 0.85, or a combination thereof.

In some embodiments, the at least three polymorphisms comprise: rs6478109, rs56124762, and rs1892231; rs6478109, rs56124762, and rs16901748; rs6478109, rs1892231, and rs16901748; rs56124762, rs1892231, and rs16901748; rs6478109, rs2070558, and rs1892231; rs6478109, rs2070558, and rs16901748; rs6478109, rs1892231, and rs16901748; rs2070558, rs1892231, and rs16901748; rs6478109, rs2070561, and rs1892231; rs6478109, rs2070561, and rs16901748; rs6478109, rs1892231, and rs16901748; rs2070561, rs1892231, and rs16901748; rs6478109, rs7935393, and rs1892231; rs6478109, rs7935393, and rs9806914; rs6478109, rs7935393, and rs7278257; rs6478109, rs7935393, and rs2070557; rs6478109, rs1892231, and rs9806914; rs6478109, rs1892231, and rs7278257; rs6478109, rs1892231, and rs2070557; rs6478109, rs9806914, and rs7278257; rs6478109, rs9806914, and rs2070557; rs6478109, rs7278257, and rs2070557; rs7935393, rs1892231, and rs9806914; rs7935393, rs1892231, and rs7278257; rs7935393, rs1892231, and rs2070557; rs7935393, rs9806914, and rs7278257; rs7935393, rs9806914, and rs2070557; rs7935393, rs7278257, and rs2070557; rs1892231, rs9806914, and rs7278257; rs1892231, rs9806914, and rs2070557; rs1892231, rs7278257, and rs2070557; or rs9806914, rs7278257, and rs2070557. In some embodiments, the at least three polymorphisms further comprises a fourth polymorphism comprising rs16901748, rs1892231, rs56124762, rs6478109, rs2070558, rs2070561, rs11897732, rs6740739, rs17796285, rs7935393, rs12934476, rs12457255, rs2070557, rs4246905, rs10974900, rs12434976, rs2815844, rs889702, rs2409750, rs1541020, rs4942248, rs12934476, rs12457255, rs2297437, rs41309367, rs10733509, rs10750376, rs10932456, rs1326860, rs1528663, rs951279, rs9806914, rs7935393, rs1690492, rs420726, rs7759385, rs10974900, rs1326860, rs2548147, rs2815844, rs889702, rs9806914, rs7278257, or rs11221332, or a proxy polymorphism in linkage disequilibrium therewith as determined with an $R^2$ of at least 0.85, or a combination thereof. In some embodiments, the at least three polymorphisms comprise rs6478109, rs56124762, and rs1892231. In some embodiments, the at least three polymorphisms comprise rs6478109, rs56124762, and rs16901748. In some embodiments, the at least three polymorphisms comprise rs6478109, rs1892231, and rs16901748. In some embodiments, the at least three polymorphisms comprise rs56124762, rs1892231, and rs16901748. In some embodiments, the proxy polymorphism in linkage disequilibrium is independently associated with a clinical phenotype associated with the inflammatory, the fibrotic, or the fibrostenotic disease or condition in the subject. In some embodiments, the clinical phenotype is stricturing and penetrating disease.

In some embodiments, the presence of the at least three polymorphisms is predictive that the subject will therapeutically respond to the inhibitor of TL1A at a positive predictive value of at least about 75%. In some embodiments, the presence of the at least three polymorphisms is predictive that the subject will therapeutically respond to the inhibitor of TL1A at a positive predictive value of at least about 80%. In some embodiments, the presence of the at least three polymorphisms is predictive that the subject will therapeutically respond to the inhibitor of TL1A at a positive predictive value of at least about 85%. In some embodiments, the presence of the at least three polymorphisms is predictive that the subject will therapeutically respond to the inhibitor of TL1A at a positive predictive value of at least about 90%. In some embodiments, the presence of the at least three polymorphisms is predictive that the subject will therapeutically respond to the inhibitor of TL1A at a positive predictive value of at least about 95%. In some embodiments, the presence of the at least three polymorphisms is predictive that the subject will therapeutically respond to the inhibitor of TL1A with a specificity of at least about 70%. In some embodiments, the presence of the at least three polymorphisms is predictive that the subject will therapeutically respond to the inhibitor of TL1A with a specificity of at least about 75%. In some embodiments, the presence of the at least three polymorphisms is predictive that the subject will therapeutically respond to the inhibitor of TL1A with a specificity of at least about 80%. In some embodiments, the presence of the at least three polymorphisms is predictive that the subject will therapeutically respond to the inhibitor of TL1A with a specificity of at least about 85%. In some embodiments, the presence of the at least three polymorphisms is predictive that the subject will therapeutically respond to the inhibitor of TL1A with a specificity of at least about 90%. In some embodiments, the presence of the at least three polymorphisms is predictive that the subject will therapeutically respond to the inhibitor of TL1A with a specificity of at least about 95%.

In some embodiments, the at least three polymorphisms are detected in the sample by subjecting the sample to an assay configured to detect a presence of at least three nucleotides corresponding to nucleic acid position 501 within SEQ ID NOS: 1-41, or 57-59. In some embodiments, the assay comprises polymerase chain reaction (PCR), quantitative reverse-transcription PCR (qPCR), automated sequencing, or genotype array.

In some embodiments, the inflammatory, fibrotic, or fibrostenotic disease or condition comprises inflammatory bowel disease, Crohn's disease, obstructive Crohn's disease, ulcerative colitis, intestinal fibrosis, intestinal fibrostenosis, rheumatoid arthritis, or primary sclerosing cholangitis. In some embodiments, the Crohn's disease is ileal, ileocolonic, or colonic Crohn's disease. In some embodiments, the subject has, or is at risk for developing, a non-response or loss-of-response to a standard therapy comprising glucocorticosteriods, anti-TNF therapy, anti-a4-b7 therapy, anti-IL12p40 therapy, or a combination thereof. In some embodiments, the inhibitor of TL1A is an anti-TL1A antibody or antigen-binding fragment. In some embodiments, the anti-TL1A antibody binds to the same region of human TL1A as a reference antibody selected from Table 2B. In some embodiments, methods further comprise administering an additional therapeutic agent to the subject.

Aspects disclosed herein provide methods of treating an inflammatory, a fibrotic, or a fibrostenotic disease or condition in a subject, the method comprising administering to the subject a therapeutically effective amount of an inhibitor of Tumor necrosis factor-like cytokine 1A (TL1A) activity or expression, provided at least three polymorphisms comprising rs1892231, rs56124762, rs6478109, rs2070558, rs2070561, rs11897732, rs6740739, rs17796285, rs7935393, rs12934476, rs12457255, rs2070557, rs4246905, rs10974900, rs12434976, rs16901748, rs2815844, rs889702, rs2409750, rs1541020, rs4942248, rs12934476, rs12457255, rs2297437, rs41309367, rs10733509, rs10750376, rs10932456, rs1326860, rs1528663, rs951279, rs9806914, rs7935393, rs1690492, rs420726, rs7759385, rs10974900, rs1326860, rs2548147, rs2815844, rs889702, rs9806914, rs7278257, or rs11221332, or a proxy polymorphism in linkage disequilibrium therewith as determined with an $R^2$ of at least 0.85, or a combination thereof, are detected in a sample obtained from the subject.

In some embodiments, the at least three polymorphisms comprise: rs6478109, rs56124762, and rs1892231; rs6478109, rs56124762, and rs16901748; rs6478109, rs1892231, and rs16901748; rs56124762, rs1892231, and rs16901748; rs6478109, rs2070558, and rs1892231; rs6478109, rs2070558, and rs16901748; rs6478109, rs1892231, and rs16901748; rs2070558, rs1892231, and rs16901748; rs6478109, rs2070561, and rs1892231; rs6478109, rs2070561, and rs16901748; rs6478109, rs1892231, and rs16901748; rs2070561, rs1892231, and rs16901748; rs6478109, rs7935393, and rs1892231; rs6478109, rs7935393, and rs9806914; rs6478109, rs7935393, and rs7278257; rs6478109, rs7935393, and rs2070557; rs6478109, rs1892231, and rs9806914; rs6478109, rs1892231, and rs7278257; rs6478109, rs1892231, and rs2070557; rs6478109, rs9806914, and rs7278257; rs6478109, rs9806914, and rs2070557; rs6478109, rs7278257, and rs2070557; rs7935393, rs1892231, and rs9806914; rs7935393, rs1892231, and rs7278257; rs7935393, rs1892231, and rs2070557; rs7935393, rs9806914, and rs7278257; rs7935393, rs9806914, and rs2070557; rs7935393, rs7278257, and rs2070557; rs1892231, rs9806914, and rs7278257; rs1892231, rs9806914, and rs2070557; rs1892231, rs7278257, and rs2070557; or rs9806914, rs7278257, and rs2070557. In some embodiments, the at least three polymorphisms further comprises a fourth polymorphism comprising rs16901748, rs1892231, rs56124762, rs6478109, rs2070558, rs2070561, rs11897732, rs6740739, rs17796285, rs7935393, rs12934476, rs12457255, rs2070557, rs4246905, rs10974900, rs12434976, rs2815844, rs889702, rs2409750, rs1541020, rs4942248, rs12934476, rs12457255, rs2297437, rs41309367, rs10733509, rs10750376, rs10932456, rs1326860, rs1528663, rs951279, rs9806914, rs7935393, rs1690492, rs420726, rs7759385, rs10974900, rs1326860, rs2548147, rs2815844, rs889702, rs9806914, rs7278257, or rs11221332, or a proxy polymorphism in linkage disequilibrium therewith as determined with an $R^2$ of at least 0.85, or a combination thereof. In some embodiments, the at least three polymorphisms comprise rs6478109, rs56124762, and rs1892231. In some embodiments, the at least three polymorphisms comprise rs6478109, rs56124762, and rs16901748. In some embodiments, the at least three polymorphisms comprise rs6478109, rs1892231, and rs16901748. In some embodiments, the at least three polymorphisms comprise rs56124762, rs1892231, and rs16901748. In some embodiments, the proxy polymorphism in linkage disequilibrium is independently associated with a clinical phenotype associated with the inflammatory, the fibrotic, or the fibrostenotic disease or condition in the subject. In some embodiments, the clinical phenotype is stricturing and penetrating disease.

In some embodiments, the presence of the at least three polymorphisms is predictive that the subject will therapeutically respond to the inhibitor of TL1A at a positive predictive value of at least about 70%. In some embodiments, the presence of the at least three polymorphisms is predictive that the subject will therapeutically respond to the inhibitor of TL1A at a positive predictive value of at least about 75%. In some embodiments, the presence of the at least three polymorphisms is predictive that the subject will therapeutically respond to the inhibitor of TL1A at a positive predictive value of at least about 80%. In some embodiments, the presence of the at least three polymorphisms is predictive that the subject will therapeutically respond to the inhibitor of TL1A at a positive predictive value of at least about 85%. In some embodiments, the presence of the at least three polymorphisms is predictive that the subject will therapeutically respond to the inhibitor of TL1A at a positive predictive value of at least about 90%. In some embodiments, the presence of the at least three polymorphisms is predictive that the subject will therapeutically respond to the inhibitor of TL1A at a positive predictive value of at least about 95%.

In some embodiments, the presence of the at least three polymorphisms is predictive that the subject will therapeutically respond to the inhibitor of TL1A with a specificity of at least about 70%. In some embodiments, the presence of the at least three polymorphisms is predictive that the subject will therapeutically respond to the inhibitor of TL1A with a specificity of at least about 75%. In some embodiments, the presence of the at least three polymorphisms is predictive that the subject will therapeutically respond to the inhibitor of TL1A with a specificity of at least about 80%. In some embodiments, the presence of the at least three polymorphisms is predictive that the subject will therapeutically respond to the inhibitor of TL1A with a specificity of at least about 85%. In some embodiments, the presence of the at least three polymorphisms is predictive that the subject will therapeutically respond to the inhibitor of TL1A with a specificity of at least about 90%. In some embodiments, the presence of the at least three polymorphisms is predictive that the subject will therapeutically respond to the inhibitor of TL1A with a specificity of at least about 95%.

In some embodiments, the at least three polymorphisms are detected in the sample by subjecting the sample to an assay configured to detect a presence of at least three nucleotides corresponding to nucleic acid position 501 within SEQ ID NOS: 1-41, or 57-59. In some embodiments, the assay comprises polymerase chain reaction (PCR), quantitative reverse-transcription PCR (qPCR), automated sequencing, or genotype array.

In some embodiments, the inflammatory, fibrotic, or fibrostenotic disease or condition comprises inflammatory bowel disease, Crohn's disease, obstructive Crohn's disease, ulcerative colitis, intestinal fibrosis, intestinal fibrostenosis, rheumatoid arthritis, or primary sclerosing cholangitis. In some embodiments, the Crohn's disease is ileal, ileocolonic, or colonic Crohn's disease. In some embodiments, the subject has, or is at risk for developing, a non-response or loss-of-response to a standard therapy comprising glucocorticosteriods, anti-TNF therapy, anti-a4-b7 therapy, anti-IL12p40 therapy, or a combination thereof. In some embodiments, the inhibitor of TL1A is an anti-TL1A antibody or antigen-binding fragment. In some embodiments, the anti-TL1A antibody binds to the same region of human TL1A as a reference antibody selected from Table 2B. In some embodiments, methods further comprise administering an additional therapeutic agent to the subject.

Aspects disclosed herein provide methods of treating an inflammatory, a fibrotic, or a fibrostenotic disease or condition in a subject, the method comprising: (a) determining whether the subject with an inflammatory, a fibrotic, or a fibrostenotic disease or condition is suitable for treatment with an inhibitor of TL1A activity or expression by: (i) obtaining or having obtained a sample from the subject; and (ii) subjecting the sample to an assay adapted to detect at least three polymorphisms that are predictive of the subject exhibiting a therapeutic response to the inhibitor of TL1A activity or expression at a positive predictive value of at least about 70%; and (b) treating the subject by administering a therapeutically effective amount of the inhibitor of TL1A activity or expression to the subject provided the at least three polymorphisms are detected. In some embodiments, the at least three polymorphisms comprise rs1892231, rs56124762, rs6478109, rs2070558, rs2070561, rs11897732, rs6740739, rs17796285, rs7935393, rs12934476, rs12457255, rs2070557, rs4246905, rs10974900, rs12434976, rs16901748, rs2815844, rs889702, rs2409750, rs1541020, rs4942248, rs12934476, rs12457255, rs2297437, rs41309367, rs10733509, rs10750376, rs10932456, rs1326860, rs1528663, rs951279, rs9806914, rs7935393, rs1690492, rs420726, rs7759385, rs10974900, rs1326860, rs2548147, rs2815844, rs889702, rs9806914, rs7278257, rs11221332, or a proxy polymorphism in linkage disequilibrium therewith as determined with an $R^2$ of at least 0.85, or a combination thereof.

In some embodiments, the at least three polymorphisms comprise: rs6478109, rs56124762, and rs1892231; rs6478109, rs56124762, and rs16901748; rs6478109, rs1892231, and rs16901748; rs56124762, rs1892231, and rs16901748; rs6478109, rs2070558, and rs1892231; rs6478109, rs2070558, and rs16901748; rs6478109, rs1892231, and rs16901748; rs2070558, rs1892231, and rs16901748; rs6478109, rs2070561, and rs1892231; rs6478109, rs2070561, and rs16901748; rs6478109, rs1892231, and rs16901748; rs2070561, rs1892231, and rs16901748; rs6478109, rs7935393, and rs1892231; rs6478109, rs7935393, and rs9806914; rs6478109, rs7935393, and rs7278257; rs6478109, rs7935393, and rs2070557; rs6478109, rs1892231, and rs9806914; rs6478109, rs1892231, and rs7278257; rs6478109, rs1892231, and rs2070557; rs6478109, rs9806914, and rs7278257; rs6478109, rs9806914, and rs2070557; rs6478109, rs7278257, and rs2070557; rs7935393, rs1892231, and rs9806914; rs7935393, rs1892231, and rs7278257; rs7935393, rs1892231, and rs2070557; rs7935393, rs9806914, and rs7278257; rs7935393, rs9806914, and rs2070557; rs7935393, rs7278257, and rs2070557; rs1892231, rs9806914, and rs7278257; rs1892231, rs9806914, and rs2070557; rs1892231, rs7278257, and rs2070557; or rs9806914, rs7278257, and rs2070557. In some embodiments, the at least three polymorphisms further comprises a fourth polymorphism comprising rs16901748, rs1892231, rs56124762, rs6478109, rs2070558, rs2070561, rs11897732, rs6740739, rs17796285, rs7935393, rs12934476, rs12457255, rs2070557, rs4246905, rs10974900, rs12434976, rs2815844, rs889702, rs2409750, rs1541020, rs4942248, rs12934476, rs12457255, rs2297437, rs41309367, rs10733509, rs10750376, rs10932456, rs1326860, rs1528663, rs951279, rs9806914, rs7935393, rs1690492, rs420726, rs7759385, rs10974900, rs1326860, rs2548147, rs2815844, rs889702, rs9806914, rs7278257, or rs11221332 or a proxy polymorphism in linkage disequilibrium therewith as determined with an $R^2$ of at least 0.85, or a combination thereof. In some embodiments, the at least three polymorphisms comprise rs6478109, rs56124762, and rs1892231. In some embodiments, the at least three polymorphisms comprise rs6478109, rs56124762, and rs16901748. In some embodiments, the at least three polymorphisms comprise rs6478109, rs1892231, and rs16901748. In some embodiments, the at least three polymorphisms comprise rs56124762, rs1892231, and rs16901748.

In some embodiments, the at least three polymorphisms are predictive that the subject will therapeutically respond to the inhibitor of TL1A at a positive predictive value of at least about 70%. In some embodiments, the at least three polymorphisms are predictive that the subject will therapeutically respond to the inhibitor of TL1A at a positive predictive value of at least about 75%. In some embodiments, the at least three polymorphisms are predictive that the subject will therapeutically respond to the inhibitor of TL1A at a positive predictive value of at least about 80%. In some embodiments, the at least three polymorphisms are predictive that the subject will therapeutically respond to the inhibitor of TL1A at a positive predictive value of at least about 85%. In some embodiments, the at least three polymorphisms are predictive that the subject will therapeutically respond to the inhibitor of TL1A at a positive predictive value of at least about 90%. In some embodiments, the at least three polymorphisms are predictive that the subject will therapeutically respond to the inhibitor of TL1A at a positive predictive value of at least about 95%.

In some embodiments, the at least three polymorphisms are predictive that the subject will therapeutically respond to the inhibitor of TL1A with a specificity of at least about 70%. In some embodiments, the at least three polymorphisms are predictive that the subject will therapeutically respond to the inhibitor of TL1A with a specificity of at least about 75%. In some embodiments, the at least three polymorphisms are predictive that the subject will therapeutically respond to the inhibitor of TL1A with a specificity of at least about 80%. In some embodiments, the at least three polymorphisms are predictive that the subject will therapeutically respond to the inhibitor of TL1A with a specificity of at least about 85%. In some embodiments, the at least three polymorphisms are predictive that the subject will therapeutically respond to the inhibitor of TL1A with a specificity of at least about 90%. In some embodiments, the at least three polymorphisms are predictive that the subject will therapeutically respond to the inhibitor of TL1A with a specificity of at least about 95%.

In some embodiments, the inflammatory, fibrotic, or fibrostenotic disease or condition comprises inflammatory bowel disease, Crohn's disease, obstructive Crohn's disease, ulcerative colitis, intestinal fibrosis, intestinal fibrostenosis, rheumatoid arthritis, or primary sclerosing cholangitis. In some embodiments, the Crohn's disease is ileal, ileocolonic, or colonic Crohn's disease. In some embodiments, the wherein the inhibitor of TL1A activity or expression is an anti-TL1A antibody or antigen-binding fragment. In some embodiments, the anti-TL1A antibody binds to the same region of human TL1A as a reference antibody selected from Table 2B. In some embodiments, methods further comprise administering an additional therapeutic agent to the subject.

In some embodiments, the subject is at risk of developing a non-response or loss-of-response to a standard therapy comprising glucocorticosteriods, anti-TNF therapy, anti-a4-b7 therapy, anti-IL12p40 therapy, or a combination thereof. In some embodiments, the proxy polymorphism in linkage disequilibrium is independently associated with a clinical phenotype associated with the inflammatory, the fibrotic, or the fibrostenotic disease or condition in the subject. In some embodiments, the clinical phenotype is stricturing and penetrating disease.

Aspects disclosed herein provide methods of treating an inflammatory, a fibrotic, or a fibrostenotic disease or condition in a subject, the method comprising: (a) determining whether the subject with an inflammatory, a fibrotic, or a fibrostenotic disease or condition is suitable for treatment with an inhibitor of TL1A activity or expression by: (i) obtaining or having obtained a sample from the subject; and (ii) subjecting the sample to an assay adapted to detect at least three polymorphisms comprising rs1892231, rs56124762, rs6478109, rs2070558, rs2070561, rs11897732, rs6740739, rs17796285, rs7935393, rs12934476, rs12457255, rs2070557, rs4246905, rs10974900, rs12434976, rs16901748, rs2815844, rs889702, rs2409750, rs1541020, rs4942248, rs12934476, rs12457255, rs2297437, rs41309367, rs10733509, rs10750376, rs10932456, rs1326860, rs1528663, rs951279, rs9806914, rs7935393, rs1690492, rs420726, rs7759385, rs10974900, rs1326860, rs2548147, rs2815844, rs889702, rs9806914, rs7278257, rs11221332, or a proxy polymorphism in linkage disequilibrium therewith as determined with an $R^2$ of at least 0.85, or a combination thereof; and (b) treating the subject by administering a therapeutically effective amount of the inhibitor of TL1A activity or expression to the subject.

In some embodiments, the at least three polymorphisms comprise: rs6478109, rs56124762, and rs1892231; rs6478109, rs56124762, and rs16901748; rs6478109, rs1892231, and rs16901748; rs56124762, rs1892231, and rs16901748; rs6478109, rs2070558, and rs1892231; rs6478109, rs2070558, and rs16901748; rs6478109, rs1892231, and rs16901748; rs2070558, rs1892231, and rs16901748; rs6478109, rs2070561, and rs1892231; rs6478109, rs2070561, and rs16901748; rs6478109, rs1892231, and rs16901748; rs2070561, rs1892231, and rs16901748; rs6478109, rs7935393, and rs1892231; rs6478109, rs7935393, and rs9806914; rs6478109, rs7935393, and rs7278257; rs6478109, rs7935393, and rs2070557; rs6478109, rs1892231, and rs9806914; rs6478109, rs1892231, and rs7278257; rs6478109, rs1892231, and rs2070557; rs6478109, rs9806914, and rs7278257; rs6478109, rs9806914, and rs2070557; rs6478109, rs7278257, and rs2070557; rs7935393, rs1892231, and rs9806914; rs7935393, rs1892231, and rs7278257; rs7935393, rs1892231, and rs2070557; rs7935393, rs9806914, and rs7278257; rs7935393, rs9806914, and rs2070557; rs7935393, rs7278257, and rs2070557; rs1892231, rs9806914, and rs7278257; rs1892231, rs9806914, and rs2070557; rs1892231, rs7278257, and rs2070557; or rs9806914, rs7278257, and rs2070557. In some embodiments, the at least three polymorphisms further comprises a fourth polymorphism comprising rs16901748, rs1892231, rs56124762, rs6478109, rs2070558, rs2070561, rs11897732, rs6740739, rs17796285, rs7935393, rs12934476, rs12457255, rs2070557, rs4246905, rs10974900, rs12434976, rs2815844, rs889702, rs2409750, rs1541020, rs4942248, rs12934476, rs12457255, rs2297437, rs41309367, rs10733509, rs10750376, rs10932456, rs1326860, rs1528663, rs951279, rs9806914, rs7935393, rs1690492, rs420726, rs7759385, rs10974900, rs1326860, rs2548147, rs2815844, rs889702, rs9806914, rs7278257, or rs11221332 or a proxy polymorphism in linkage disequilibrium therewith as determined with an $R^2$ of at least 0.85, or a combination thereof. In some embodiments, the at least three polymorphisms comprise rs6478109, rs56124762, and rs1892231. In some embodiments, the at least three polymorphisms comprise rs6478109, rs56124762, and rs16901748. In some embodiments, the at least three polymorphisms comprise rs6478109, rs1892231, and rs16901748. In some embodiments, the at least three polymorphisms comprise rs56124762, rs1892231, and rs16901748.

In some embodiments, the at least three polymorphisms are predictive that the subject will therapeutically respond to the inhibitor of TL1A at a positive predictive value of at least about 70%. In some embodiments, the at least three polymorphisms are predictive that the subject will therapeutically respond to the inhibitor of TL1A at a positive predictive value of at least about 75%. In some embodiments, the at least three polymorphisms are predictive that the subject will therapeutically respond to the inhibitor of TL1A at a positive predictive value of at least about 80%. In some embodiments, the at least three polymorphisms are predictive that the subject will therapeutically respond to the inhibitor of TL1A at a positive predictive value of at least about 85%. In some embodiments, the at least three polymorphisms are predictive that the subject will therapeutically respond to the inhibitor of TL1A at a positive predictive value of at least about 90%. In some embodiments, the at least three polymorphisms are predictive that the subject will therapeutically respond to the inhibitor of TL1A at a positive predictive value of at least about 95%.

In some embodiments, the at least three polymorphisms are predictive that the subject will therapeutically respond to the inhibitor of TL1A with a specificity of at least about 70%. In some embodiments, the at least three polymorphisms are predictive that the subject will therapeutically respond to the inhibitor of TL1A with a specificity of at least about 75%. In some embodiments, the at least three polymorphisms are predictive that the subject will therapeutically respond to the inhibitor of TL1A with a specificity of at least about 80%. In some embodiments, the at least three polymorphisms are predictive that the subject will therapeutically respond to the inhibitor of TL1A with a specificity of at least about 85%. In some embodiments, the at least three polymorphisms are predictive that the subject will therapeutically respond to the inhibitor of TL1A with a specificity of at least about 90%. In some embodiments, the at least three polymorphisms are predictive that the subject will therapeutically respond to the inhibitor of TL1A with a specificity of at least about 95%.

In some embodiments, the inflammatory, fibrotic, or fibrostenotic disease or condition comprises inflammatory bowel disease, Crohn's disease, obstructive Crohn's disease, ulcerative colitis, intestinal fibrosis, intestinal fibrostenosis, rheumatoid arthritis, or primary sclerosing cholangitis. In some embodiments, the Crohn's disease is ileal, ileocolonic, or colonic Crohn's disease.

In some embodiments, the wherein the inhibitor of TL1A activity or expression is an anti-TL1A antibody or antigen-binding fragment. In some embodiments, the anti-TL1A antibody binds to the same region of human TL1A as a reference antibody selected from Table 2B. In some embodiments, methods further comprise administering an additional therapeutic agent to the subject.

In some embodiments, the subject is at risk of developing a non-response or loss-of-response to a standard therapy comprising glucocorticosteriods, anti-TNF therapy, anti-a4-b7 therapy, anti-IL12p40 therapy, or a combination thereof. In some embodiments, the proxy polymorphism in linkage disequilibrium is independently associated with a clinical phenotype associated with the inflammatory, the fibrotic, or the fibrostenotic disease or condition in the subject. In some embodiments, the clinical phenotype is stricturing and penetrating disease.

Aspects disclosed herein provide methods of treating an inflammatory, a fibrotic, or a fibrostenotic disease or condition in a subject, the method comprising administering to the subject a therapeutically effective amount of an inhibitor of TL1A activity or expression, wherein the subject expresses at least three polymorphisms comprising rs16901748, rs6478109, rs56124762, or a proxy polymorphism in linkage disequilibrium therewith as determined with an $R^2$ of at least 0.85. In some embodiments, the at least three polymorphisms further comprises a fourth polymorphism comprising rs16901748, rs1892231, rs56124762, rs6478109, rs2070558, rs2070561, rs11897732, rs6740739, rs17796285, rs7935393, rs12934476, rs12457255, rs2070557, rs4246905, rs10974900, rs12434976, rs2815844, rs889702, rs2409750, rs1541020, rs4942248, rs12934476, rs12457255, rs2297437, rs41309367, rs10733509, rs10750376, rs10932456, rs1326860, rs1528663, rs951279, rs9806914, rs7935393, rs1690492, rs420726, rs7759385, rs10974900, rs1326860, rs2548147, rs2815844, rs889702, rs9806914, rs7278257, or rs11221332 or a proxy polymorphism in linkage disequilibrium therewith as determined with an $R^2$ of at least 0.85, or a combination thereof. In some embodiments, the at least three polymorphisms are predictive that the subject will therapeutically respond to the inhibitor of TL1A at a positive predictive value of at least about 70%. In some embodiments, the at least three polymorphisms are predictive that the subject will therapeutically respond to the inhibitor of TL1A at a positive predictive value of at least about 75%. In some embodiments, the at least three polymorphisms are predictive that the subject will therapeutically respond to the inhibitor of TL1A at a positive predictive value of at least about 80%. In some embodiments, the at least three polymorphisms are predictive that the subject will therapeutically respond to the inhibitor of TL1A at a positive predictive value of at least about 85%. In some embodiments, the at least three polymorphisms are predictive that the subject will therapeutically respond to the inhibitor of TL1A at a positive predictive value of at least about 90%. In some embodiments, the at least three polymorphisms are predictive that the subject will therapeutically respond to the inhibitor of TL1A at a positive predictive value of at least about 95%. In some embodiments, the at least three polymorphisms are predictive that the subject will therapeutically respond to the inhibitor of TL1A with a specificity of at least about 70%. In some embodiments, the at least three polymorphisms are predictive that the subject will therapeutically respond to the inhibitor of TL1A with a specificity of at least about 75%. In some embodiments, the at least three polymorphisms are predictive that the subject will therapeutically respond to the inhibitor of TL1A with a specificity of at least about 80%. In some embodiments, the at least three polymorphisms are predictive that the subject will therapeutically respond to the inhibitor of TL1A with a specificity of at least about 85%. In some embodiments, the at least three polymorphisms are predictive that the subject will therapeutically respond to the inhibitor of TL1A with a specificity of at least about 90%. In some embodiments, the at least three polymorphisms are predictive that the subject will therapeutically respond to the inhibitor of TL1A with a specificity of at least about 95%.=In some embodiments, the inflammatory, fibrotic, or fibrostenotic disease or condition comprises inflammatory bowel disease, Crohn's disease, obstructive Crohn's disease, ulcerative colitis, intestinal fibrosis, intestinal fibrostenosis, rheumatoid arthritis, or primary sclerosing cholangitis. In some embodiments, the Crohn's disease is ileal, ileocolonic, or colonic Crohn's disease. In some embodiments, the wherein the inhibitor of TL1A activity or expression is an anti-TL1A antibody or antigen-binding fragment. In some embodiments, the anti-TL1A antibody binds to the same region of human TL1A as a reference antibody selected from Table 2B. In some embodiments, methods further comprise administering an additional therapeutic agent to the subject. In some embodiments, the subject is at risk of developing a non-response or loss-of-response to a standard therapy comprising glucocorticosteriods, anti-TNF therapy, anti-a4-b7 therapy, anti-IL12p40 therapy, or a combination thereof. In some embodiments, the proxy polymorphism in linkage disequilibrium is independently associated with a clinical phenotype associated with the inflammatory, the fibrotic, or the fibrostenotic disease or condition in the subject. In some embodiments, the clinical phenotype is stricturing and penetrating disease.

Aspects disclosed herein provide methods comprising: (a) providing a sample obtained from a subject with an inflammatory, a fibrotic, or a fibrostenotic disease or condition; and (b) detecting a presence of at least three polymorphisms in the sample with a genotyping assay, wherein the presence of the at least three polymorphisms is predictive of a therapeutic response in the subject to a treatment with an inhibitor of TL1A activity or expression at a positive predictive value of at least about 70%. In some embodiments, the at least three polymorphisms comprise rs1892231, rs56124762, rs6478109, rs2070558, rs2070561, rs11897732, rs6740739, rs17796285, rs7935393, rs12934476, rs12457255, rs2070557, rs4246905, rs10974900, rs12434976, rs16901748, rs2815844, rs889702, rs2409750, rs1541020, rs4942248, rs12934476, rs12457255, rs2297437, rs41309367, rs10733509, rs10750376, rs10932456, rs1326860, rs1528663, rs951279, rs9806914, rs7935393, rs1690492, rs420726, rs7759385, rs10974900, rs1326860, rs2548147, rs2815844, rs889702, rs9806914, rs7278257, rs11221332, or a proxy polymorphism in linkage disequilibrium therewith as determined with an R$^2$ of at least 0.85, or a combination thereof.

In some embodiments, detecting the at least three polymorphisms comprises detecting at least three genotypes corresponding to nucleic acid position 501 within at least three of SEQ ID NOS: 1-41, or 57-59. In some embodiments, the presence of at least three polymorphisms is predictive that the subject will therapeutically respond to the inhibitor of TL1A at a positive predictive value of at least about 75%. In some embodiments, the presence of at least three polymorphisms is predictive that the subject will therapeutically respond to the inhibitor of TL1A at a positive predictive value of at least about 80%. In some embodiments, the presence of at least three polymorphisms is predictive that the subject will therapeutically respond to the inhibitor of TL1A at a positive predictive value of at least about 85%. In some embodiments, the presence of at least three polymorphisms is predictive that the subject will therapeutically respond to the inhibitor of TL1A at a positive predictive value of at least about 90%. In some embodiments, the presence of at least three polymorphisms is predictive that the subject will therapeutically respond to the inhibitor of TL1A at a positive predictive value of at least about 95%.

In some embodiments, the presence of at least three polymorphisms is predictive that the subject will therapeutically respond to the inhibitor of TL1A with a specificity of at least about 70%. In some embodiments, the presence of at least three polymorphisms is predictive that the subject will therapeutically respond to the inhibitor of TL1A with a specificity of at least about 75%. In some embodiments, the presence of at least three polymorphisms is predictive that the subject will therapeutically respond to the inhibitor of TL1A with a specificity of at least about 80%. In some embodiments, the presence of at least three polymorphisms is predictive that the subject will therapeutically respond to the inhibitor of TL1A with a specificity of at least about 85%. In some embodiments, the presence of at least three polymorphisms is predictive that the subject will therapeutically respond to the inhibitor of TL1A with a specificity of at least about 90%. In some embodiments, the presence of at least three polymorphisms is predictive that the subject will therapeutically respond to the inhibitor of TL1A with a specificity of at least about 95%.

In some embodiments, methods further comprise administering to the subject a therapeutically effective amount of the inhibitor of TL1A activity or expression to treat the inflammatory, fibrotic, or fibrostenotic disease or condition. In some embodiments, the subject is at risk of developing a non-response or loss-of-response to a standard therapy comprising glucocorticosteriods, anti-TNF therapy, anti-a4-b7 therapy, anti-IL12p40 therapy, or a combination thereof. In some embodiments, the inflammatory, fibrotic, or fibrostenotic disease or condition comprises inflammatory bowel disease, Crohn's disease, obstructive Crohn's disease, ulcerative colitis, intestinal fibrosis, intestinal fibrostenosis, rheumatoid arthritis, or primary sclerosing cholangitis. In some embodiments, the Crohn's disease is ileal, ileocolonic, or colonic Crohn's disease.

In some embodiments, the wherein the inhibitor of TL1A activity or expression is an anti-TL1A antibody or antigen-binding fragment. In some embodiments, the anti-TL1A antibody binds to the same region of human TL1A as a reference antibody selected from Table 2B. In some embodiments, methods further comprise administering an additional therapeutic agent to the subject.

In some embodiments, the at least three polymorphisms comprise: rs6478109, rs56124762, and rs1892231; rs6478109, rs56124762, and rs16901748; rs6478109, rs1892231, and rs16901748; rs56124762, rs1892231, and rs16901748; rs6478109, rs2070558, and rs1892231; rs6478109, rs2070558, and rs16901748; rs6478109, rs1892231, and rs16901748; rs2070558, rs1892231, and rs16901748; rs6478109, rs2070561, and rs1892231; rs6478109, rs2070561, and rs16901748; rs6478109, rs1892231, and rs16901748; rs2070561, rs1892231, and rs16901748; rs6478109, rs7935393, and rs1892231; rs6478109, rs7935393, and rs9806914; rs6478109, rs7935393, and rs7278257; rs6478109, rs7935393, and rs2070557; rs6478109, rs1892231, and rs9806914; rs6478109, rs1892231, and rs7278257; rs6478109, rs1892231, and rs2070557; rs6478109, rs9806914, and rs7278257; rs6478109, rs9806914, and rs2070557; rs6478109, rs7278257, and rs2070557; rs7935393, rs1892231, and rs9806914; rs7935393, rs1892231, and rs7278257; rs7935393, rs1892231, and rs2070557; rs7935393, rs9806914, and rs7278257; rs7935393, rs9806914, and rs2070557; rs7935393, rs7278257, and rs2070557; rs1892231, rs9806914, and rs7278257; rs1892231, rs9806914, and rs2070557; rs1892231, rs7278257, and rs2070557; or rs9806914, rs7278257, and rs2070557. In some embodiments, the at least three polymorphisms further comprises a fourth polymorphism comprising rs16901748, rs1892231, rs56124762, rs6478109, rs2070558, rs2070561, rs11897732, rs6740739, rs17796285, rs7935393, rs12934476, rs12457255, rs2070557, rs4246905, rs10974900, rs12434976, rs2815844, rs889702, rs2409750, rs1541020, rs4942248, rs12934476, rs12457255, rs2297437, rs41309367, rs10733509, rs10750376, rs10932456, rs1326860, rs1528663, rs951279, rs9806914, rs7935393, rs1690492, rs420726, rs7759385, rs10974900, rs1326860, rs2548147, rs2815844, rs889702, rs9806914, rs7278257, or rs11221332, or a combination thereof. In some embodiments, the at least three polymorphisms comprise rs6478109, rs56124762, and rs1892231. In some embodiments, the at least three polymorphisms comprise rs6478109, rs56124762, and rs16901748. In some embodiments, the at least three polymorphisms comprise rs6478109, rs1892231, and rs16901748. In some embodiments, the at least three polymorphisms comprise rs56124762, rs1892231, and rs16901748. In some embodiments, the proxy polymorphism in linkage disequilibrium is independently associated with a clinical phenotype associated with the inflammatory, the fibrotic, or the fibrostenotic disease or condition in the subject. In some embodiments, the clinical phenotype is stricturing and penetrating disease.

Aspects disclosed herein provide methods comprising: (a) providing a sample obtained from a subject with an inflammatory, a fibrotic, or a fibrostenotic disease or condition; and (b) detecting a presence of at least three polymorphisms in the sample with a genotyping assay, said at least three polymorphisms comprising rs1892231, rs56124762, rs6478109, rs2070558, rs2070561, rs11897732, rs6740739, rs17796285, rs7935393, rs12934476, rs12457255, rs2070557, rs4246905, rs10974900, rs12434976, rs16901748, rs2815844, rs889702, rs2409750, rs1541020, rs4942248, rs12934476, rs12457255, rs2297437, rs41309367, rs10733509, rs10750376, rs10932456, rs1326860, rs1528663, rs951279, rs9806914, rs7935393, rs1690492, rs420726, rs7759385, rs10974900, rs1326860, rs2548147, rs2815844, rs889702, rs9806914, rs7278257, rs11221332, or a proxy polymorphism in linkage disequilibrium therewith as determined with an $R^2$ of at least 0.85, or a combination thereof.

In some embodiments, detecting the at least three polymorphisms comprises detecting at least three genotypes corresponding to nucleic acid position 501 within at least three of SEQ ID NOS: 1-41, or 57-59. In some embodiments, the presence of at least three polymorphisms is predictive of a therapeutic response in a subject to a treatment with the inhibitor of TL1A at a positive predictive value of at least about 70%. In some embodiments, the presence of at least three polymorphisms is predictive of a therapeutic response in a subject to a treatment with the inhibitor of TL1A at a positive predictive value of at least about 75%. In some embodiments, the presence of at least three polymorphisms is predictive of a therapeutic response in a subject to a treatment with the inhibitor of TL1A at a positive predictive value of at least about 80%. In some embodiments, the presence of at least three polymorphisms is predictive of a therapeutic response in a subject to a treatment with the inhibitor of TL1A at a positive predictive value of at least about 85%. In some embodiments, the presence of at least three polymorphisms is predictive of a therapeutic response in a subject to a treatment with the inhibitor of TL1A at a positive predictive value of at least about 90%. In some embodiments, the presence of at least three polymorphisms is predictive of a therapeutic response in a subject to a treatment with the inhibitor of TL1A at a positive predictive value of at least about 95%.

In some embodiments, the presence of at least three polymorphisms is predictive of a therapeutic response in a subject to a treatment with the inhibitor of TL1A with a specificity of at least about 70%. In some embodiments, the presence of at least three polymorphisms is predictive of a therapeutic response in a subject to a treatment with the inhibitor of TL1A with a specificity of at least about 75%. In some embodiments, the presence of at least three polymorphisms is predictive of a therapeutic response in a subject to a treatment with the inhibitor of TL1A with a specificity of at least about 80%. In some embodiments, the presence of at least three polymorphisms is predictive of a therapeutic response in a subject to a treatment with the inhibitor of TL1A with a specificity of at least about 85%. In some embodiments, the presence of at least three polymorphisms is predictive of a therapeutic response in a subject to a treatment with the inhibitor of TL1A with a specificity of at least about 90%. In some embodiments, the presence of at least three polymorphisms is predictive of a therapeutic response in a subject to a treatment with the inhibitor of TL1A with a specificity of at least about 95%.

In some embodiments, methods further comprise administering to the subject a therapeutically effective amount of the inhibitor of TL1A activity or expression to treat the inflammatory, fibrotic, or fibrostenotic disease or condition. In some embodiments, the subject is at risk of developing a non-response or loss-of-response to a standard therapy comprising glucocorticosteriods, anti-TNF therapy, anti-a4-b7 therapy, anti-IL12p40 therapy, or a combination thereof. In some embodiments, the inflammatory, fibrotic, or fibrostenotic disease or condition comprises inflammatory bowel disease, Crohn's disease, obstructive Crohn's disease, ulcerative colitis, intestinal fibrosis, intestinal fibrostenosis, rheumatoid arthritis, or primary sclerosing cholangitis. In some embodiments, the Crohn's disease is ileal, ileocolonic, or colonic Crohn's disease.

In some embodiments, the wherein the inhibitor of TL1A activity or expression is an anti-TL1A antibody or antigen-binding fragment. In some embodiments, the anti-TL1A antibody binds to the same region of human TL1A as a reference antibody selected from Table 2B. In some embodiments, methods further comprise administering an additional therapeutic agent to the subject.

In some embodiments, the at least three polymorphisms comprise: rs6478109, rs56124762, and rs1892231; rs6478109, rs56124762, and rs16901748; rs6478109, rs1892231, and rs16901748; rs56124762, rs1892231, and rs16901748; rs6478109, rs2070558, and rs1892231; rs6478109, rs2070558, and rs16901748; rs6478109, rs1892231, and rs16901748; rs2070558, rs1892231, and rs16901748; rs6478109, rs2070561, and rs1892231; rs6478109, rs2070561, and rs16901748; rs6478109, rs1892231, and rs16901748; rs2070561, rs1892231, and rs16901748; rs6478109, rs7935393, and rs1892231; rs6478109, rs7935393, and rs9806914; rs6478109, rs7935393, and rs7278257; rs6478109, rs7935393, and rs2070557; rs6478109, rs1892231, and rs9806914; rs6478109, rs1892231, and rs7278257; rs6478109, rs1892231, and rs2070557; rs6478109, rs9806914, and rs7278257; rs6478109, rs9806914, and rs2070557; rs6478109, rs7278257, and rs2070557; rs7935393, rs1892231, and rs9806914; rs7935393, rs1892231, and rs7278257; rs7935393, rs1892231, and rs2070557; rs7935393, rs9806914, and rs7278257; rs7935393, rs9806914, and rs2070557; rs7935393, rs7278257, and rs2070557; rs1892231, rs9806914, and rs7278257; rs1892231, rs9806914, and rs2070557; rs1892231, rs7278257, and rs2070557; or rs9806914, rs7278257, and rs2070557. In some embodiments, the at least three polymorphisms further comprises a fourth polymorphism comprising rs16901748, rs1892231, rs56124762, rs6478109, rs2070558, rs2070561, rs11897732, rs6740739, rs17796285, rs7935393, rs12934476, rs12457255, rs2070557, rs4246905, rs10974900, rs12434976, rs2815844, rs889702, rs2409750, rs1541020, rs4942248, rs12934476, rs12457255, rs2297437, rs41309367, rs10733509, rs10750376, rs10932456, rs1326860, rs1528663, rs951279, rs9806914, rs7935393, rs1690492, rs420726, rs7759385, rs10974900, rs1326860, rs2548147, rs2815844, rs889702, rs9806914, rs7278257, or rs11221332, or a combination thereof. In some embodiments, the at least three polymorphisms comprise rs6478109, rs56124762, and rs1892231. In some embodiments, the at least three polymorphisms comprise rs6478109, rs56124762, and rs16901748. In some embodiments, the at least three polymorphisms comprise rs6478109, rs1892231, and rs16901748. In some embodiments, the at least three polymorphisms comprise rs56124762, rs1892231, and rs16901748. In some embodiments, the proxy polymorphism in linkage disequilibrium is independently associated with a clinical phenotype associated with the inflammatory, the fibrotic, or the fibrostenotic disease or condition in the subject. In some embodiments, the clinical phenotype is stricturing and penetrating disease.

Aspects disclosed herein provide computer-implemented methods comprising: (a) receiving genotype data of a subject with an inflammatory, a fibrotic, or a fibrostenotic disease or condition; and (b) analyzing the genotype data to detect a presence of at least three genotypes predictive of a therapeutic response in the subject to a treatment with an inhibitor of Tumor necrosis factor-like cytokine 1A (TL1A) activity or expression to treat the inflammatory, the fibrotic, or the fibrostenotic disease or condition with a positive predictive value of at least about 70%. In some embodiments, the at least three genotypes comprise at least three polymorphisms comprising rs1892231, rs56124762, rs6478109, rs2070558, rs2070561, rs11897732, rs6740739, rs17796285, rs7935393, rs12934476, rs12457255, rs2070557, rs4246905, rs10974900, rs12434976, rs16901748, rs2815844, rs889702, rs2409750, rs1541020, rs4942248, rs12934476, rs12457255, rs2297437, rs41309367, rs10733509, rs10750376, rs10932456, rs1326860, rs1528663, rs951279, rs9806914, rs7935393, rs1690492, rs420726, rs7759385, rs10974900, rs1326860, rs2548147, rs2815844, rs889702, rs9806914, rs7278257, or rs11221332, or a proxy polymorphism in linkage disequilibrium therewith as determined with an $R^2$ of at least 0.85, or a combination thereof.

In some embodiments, methods further comprise generating a TNFSF15 profile comprising a positive, a negative, or an indeterminant result for a therapeutic response to a treatment with the inhibitor of TL1A activity or expression.

In some embodiments, determining the likelihood that the subject will therapeutically respond to the treatment with the inhibitor of TL1A activity or expression is performed at a positive predictive value of at least about 70%. In some embodiments, determining the likelihood that the subject will therapeutically respond to the treatment with the inhibitor of TL1A activity or expression is performed at a positive predictive value of at least about 75%. In some embodiments, determining the likelihood that the subject will therapeutically respond to the treatment with the inhibitor of TL1A activity or expression is performed at a positive predictive value of at least about 80%. In some embodiments, determining the likelihood that the subject will therapeutically respond to the treatment with the inhibitor of TL1A activity or expression is performed at a positive predictive value of at least about 85%. In some embodiments, determining the likelihood that the subject will therapeutically respond to the treatment with the inhibitor of TL1A activity or expression is performed at a positive predictive value of at least about 90%. In some embodiments, determining the likelihood that the subject will therapeutically respond to the treatment with the inhibitor of TL1A activity or expression is performed at a positive predictive value of at least about 95%.

In some embodiments, determining the likelihood that the subject will therapeutically respond to the treatment with the inhibitor of TL1A activity or expression is performed at with a specificity of at least about 70%. In some embodiments, determining the likelihood that the subject will therapeutically respond to the treatment with the inhibitor of TL1A activity or expression is performed at with a specificity of at least about 75%. In some embodiments, determining the likelihood that the subject will therapeutically respond to the treatment with the inhibitor of TL1A activity or expression is performed at with a specificity of at least about 80%. In some embodiments, determining the likelihood that the subject will therapeutically respond to the treatment with the inhibitor of TL1A activity or expression is performed at with a specificity of at least about 85%. In some embodiments, determining the likelihood that the subject will therapeutically respond to the treatment with the inhibitor of TL1A activity or expression is performed at with a specificity of at least about 90%. In some embodiments, determining the likelihood that the subject will therapeutically respond to the treatment with the inhibitor of TL1A activity or expression is performed at with a specificity of at least about 95%.

In some embodiments, the at least three polymorphisms comprise: rs6478109, rs56124762, and rs1892231; rs6478109, rs56124762, and rs16901748; rs6478109, rs1892231, and rs16901748; rs56124762, rs1892231, and rs16901748; rs6478109, rs2070558, and rs1892231; rs6478109, rs2070558, and rs16901748; rs6478109, rs1892231, and rs16901748; rs2070558, rs1892231, and rs16901748; rs6478109, rs2070561, and rs1892231; rs6478109, rs2070561, and rs16901748; rs6478109, rs1892231, and rs16901748; rs2070561, rs1892231, and rs16901748; rs6478109, rs7935393, and rs1892231; rs6478109, rs7935393, and rs9806914; rs6478109, rs7935393, and rs7278257; rs6478109, rs7935393, and rs2070557; rs6478109, rs1892231, and rs9806914; rs6478109, rs1892231, and rs7278257; rs6478109, rs1892231, and rs2070557; rs6478109, rs9806914, and rs7278257; rs6478109, rs9806914, and rs2070557; rs6478109, rs7278257, and rs2070557; rs7935393, rs1892231, and rs9806914; rs7935393, rs1892231, and rs7278257; rs7935393, rs1892231, and rs2070557; rs7935393, rs9806914, and rs7278257; rs7935393, rs9806914, and rs2070557; rs7935393, rs7278257, and rs2070557; rs1892231, rs9806914, and rs7278257; rs1892231, rs9806914, and rs2070557; rs1892231, rs7278257, and rs2070557; or rs9806914, rs7278257, and rs2070557. In some embodiments, the at least three polymorphisms further comprises a fourth polymorphism comprising rs16901748, rs1892231, rs56124762, rs6478109, rs2070558, rs2070561, rs11897732, rs6740739, rs17796285, rs7935393, rs12934476, rs12457255, rs2070557, rs4246905, rs10974900, rs12434976, rs2815844, rs889702, rs2409750, rs1541020, rs4942248, rs12934476, rs12457255, rs2297437, rs41309367, rs10733509, rs10750376, rs10932456, rs1326860, rs1528663, rs951279, rs9806914, rs7935393, rs1690492, rs420726, rs7759385, rs10974900, rs1326860, rs2548147, rs2815844, rs889702, rs9806914, rs7278257, or rs11221332, or a proxy polymorphism in linkage disequilibrium therewith as determined with an $R^2$ of at least 0.85, or a combination thereof. In some embodiments, the at least three polymorphisms comprise rs6478109, rs56124762, and rs1892231. In some embodiments, the at least three polymorphisms comprise rs6478109, rs56124762, and rs16901748. In some embodiments, the at least three polymorphisms comprise rs6478109, rs1892231, and rs16901748. In some embodiments, the at least three polymorphisms comprise rs56124762, rs1892231, and rs16901748.

In some embodiments, methods further comprise generating a report comprising the TNFSF15 profile for display to a user. In some embodiments, the inflammatory, the fibrotic, and the fibrostenotic disease or condition comprises inflammatory bowel disease, Crohn's disease, obstructive Crohn's disease, ulcerative colitis, intestinal fibrosis, intestinal fibrostenosis, rheumatoid arthritis, or primary sclerosing cholangitis. In some embodiments, the Crohn's disease is ileal, ileocolonic, or colonic Crohn's disease. In some embodiments, the inhibitor of TL1A activity or expression is an anti-TL1A antibody or antigen-binding fragment. In some embodiments, the anti-TL1A antibody binds to the same region of human TL1A as a reference antibody selected from Table 2B. In some embodiments, the proxy polymorphism in linkage disequilibrium is independently associated with a clinical phenotype associated with the inflammatory, the fibrotic, or the fibrostenotic disease or condition in the subject. In some embodiments, the clinical phenotype is stricturing and penetrating disease.

Aspects disclosed herein provide kits comprising: (a) at least three primer pairs, each primer pair comprising a first primer and a second primer, where said first primer comprises at least 10 contiguous nucleic acids corresponding to nucleotides 4090-500 of SEQ ID NOS: 1-41, or 57-59, and wherein said second primer comprises at least 10 contiguous nucleic acids corresponding to nucleotides 4090-500 of a reverse complement to SEQ ID NOS: 1-41, or 57-59; and (b) at least three polynucleotide molecules, each polynucleotide molecule comprising a detectable moiety, wherein the polynucleotide molecule comprises a nucleic acid sequence comprising a nucleotide corresponding to nucleotide position 501 of SEQ ID NOS: 1-41, or 57-59. In some embodiments, the kit is useful for selecting a patient with an inflammatory, a fibrotic, or a fibrostenotic disease or condition for treatment with an inhibitor of TL1A activity or expression, provided the presence of the at least three polymorphisms is detected in a sample obtained from the patient.

Aspects disclosed herein provide kits comprising: (a) a first primer pair comprising a first forward primer provided in any one of SEQ ID NOS: 364101-364110 and a corresponding first reverse primer provided in SEQ ID NO: in any one of SEQ ID NOS: 364111-364120; (b) a second primer pair comprising a second forward primer provided in any one of SEQ ID NOS: 364101-364110 and a corresponding second reverse primer provided in any one of SEQ ID NOS: 364111-364120; (c) a third primer pair comprising a third forward primer provided in any one of SEQ ID NOS: 364101-364110 and a corresponding third reverse primer provided in any one of SEQ ID NOS: 364111-364120, wherein the first primer pair, the second primer pair, and the third primer pair are not the same; and (d) at least three polynucleotide molecules, each polynucleotide molecule comprising a detectable moiety, wherein the polynucleotide molecule comprises a nucleic acid sequence comprising a nucleotide corresponding to nucleotide position 501 of SEQ ID NOS: 1-41, or 57-59. In some embodiments, the kit is useful for selecting a patient with an inflammatory, a fibrotic, or a fibrostenotic disease or condition for treatment with an inhibitor of TL1A activity or expression, provided the presence of the at least three polymorphisms is detected in a sample obtained from the patient.

Aspects disclosed herein provide methods of selecting a patient with an inflammatory, a fibrotic, or a fibrostenotic disease or condition for treatment with an inhibitor of TL1A activity or expression, the method comprising: (a) assaying a sample obtained from the subject using the kit of the present disclosure; (b) detecting at least three genotypes in the sample; and (c) selecting the patient for treatment with an inhibitor of TL1A activity or expression to treat an inflammatory, a fibrotic, or a fibrostenotic disease or condition in the subject. In some embodiments, methods further comprise administering the inhibitor of TL1A activity or expression to the patient to treat the inflammatory, the fibrotic, or the fibrostenotic disease or condition in the subject.

Aspects of the present disclosure provide a non-transitory computer readable medium comprising machine executable code that, upon execution by one or more computer processors, implements any of the methods above or elsewhere herein.

Aspects of the present disclosure provide a system comprising one or more computer processors and computer memory coupled thereto. The computer memory comprises machine executable code that, upon execution by the one or more computer processors, implements any of the methods above or elsewhere herein.

Aspects provided herein provide methods of treating at least one of an inflammatory, a fibrotic, and a fibrostenotic disease or condition in a subject, the method comprising administering to the subject a therapeutically effective amount of an inhibitor of TL1A activity or expression, provided a presence of a genotype is detected in a sample obtained from the subject, the genotype comprising at least three polymorphisms provided in Table 1. In some embodiments, the at least three polymorphisms is selected from the group consisting of rs11897732, rs6740739, rs17796285, rs7935393, rs12934476, rs12457255, rs2070557, rs4246905, rs10974900, rs12434976, rs16901748, rs2815844, rs889702, rs2409750, rs1541020, rs4942248, rs12934476, rs12457255, rs2297437, rs41309367, rs10733509, rs10750376, rs10932456, rs1326860, rs1528663, rs1892231, rs951279, rs9806914, rs7935393, rs1690492, rs420726, rs7759385, rs10974900, rs1326860, rs2548147, rs2815844, rs889702, rs9806914, rs6478109, rs7278257, and rs11221332. In some embodiments, the at least three polymorphisms are selected from the group consisting of a "G" allele at rs11897732, an "A" allele at rs6740739, a "G" allele at rs17796285, an "A" allele at rs7935393, a "G" allele at rs12934476, an "A" allele at rs12457255, an "A" allele at rs2070557, an "A" allele at rs4246905, an "A" allele at rs10974900, a "C" allele at rs12434976, an "A" allele at rs16901748, an "A" allele at rs2815844, a "G" allele at rs889702, a "C" allele at rs2409750, an "A" allele at rs1541020, a "T" allele at rs4942248, a "G" allele at rs12934476, an "A" allele at rs12457255, an "A" allele at rs2297437, a "G" allele at rs41309367, an "A" allele at rs10733509, a "G" allele at rs10750376, a "G" allele at rs10932456, an "A" allele at rs1326860, a "G" allele at rs1528663, a "C" allele at rs1892231, an "A" allele at rs951279, an "A" allele at rs9806914, an "A" allele at rs7935393, a "G" allele at rs1690492, an "A" allele at rs420726, a "T" allele at rs7759385, an "A" allele at rs10974900, an "A" allele at rs1326860, a "C" allele at rs2548147, an "A" allele at rs2815844, a "G" allele at rs889702, an "A" allele at rs9806914, an "A" allele at rs6478109, a "C" allele at rs7278257, and an "A" allele at rs11221332. In some embodiments, a polymorphism of the at least three polymorphisms comprises a minor allele provided in Table 1. In some embodiments, a polymorphism of the at least three polymorphisms comprises a major allele provided in Table 1. In some embodiments, the genotype is heterozygous. In some embodiments, the genotype is homozygous. In some embodiments, the at least three polymorphisms comprise imm_9_116608587, imm_11_127948309, and rs1892231. In some embodiments, the at least three polymorphisms comprise imm_9_116608587, imm_11_127948309, and rs9806914. In some embodiments, the at least three polymorphisms comprise imm_9_116608587, imm_11_127948309, and imm_21_44478192. In some embodiments, the at least three polymorphisms comprise imm_9_116608587, imm_11_127948309, and imm_21_44479552. In some embodiments, the at least three polymorphisms comprise imm_9_116608587, rs1892231, and rs9806914. In some embodiments, the at least three polymorphisms comprise imm_9_116608587, rs1892231, and imm_21_44478192. In some embodiments, the at least three polymorphisms comprise imm_9_116608587, rs1892231, and imm_21_44479552. In some embodiments, the at least three polymorphisms comprise imm_9_116608587, rs9806914, and imm_21_44478192. In some embodiments, the at least three polymorphisms comprise imm_9_116608587, rs9806914, and imm_21_44479552. In some embodiments, the at least three polymorphisms comprise imm_9_116608587, imm_21_44478192, and imm_21_44479552. In some embodiments, the at least three polymorphisms comprise imm_11_127948309, rs1892231, and rs9806914. In some embodiments, the at least three polymorphisms comprise imm_11_127948309, rs1892231, and imm_21_44478192. In some embodiments, the at least three polymorphisms comprise imm_11_127948309, rs1892231, and imm_21_44479552. In some embodiments, the at least three polymorphisms comprise imm_11_127948309, rs9806914, and imm_21_44478192. In some embodiments, the at least three polymorphisms comprise imm_11_127948309, rs9806914, and imm_21_44479552. In some embodiments, the at least three polymorphisms comprise imm_11_127948309, imm_21_44478192, and imm_21_44479552. In some embodiments, the at least three polymorphisms comprise rs1892231, rs9806914, and imm_21_44478192. In some embodiments, the at least three polymorphisms comprise rs1892231, rs9806914, and imm_21_44479552. In some embodiments, the at least three polymorphisms comprise rs1892231, imm_21_44478192, and imm_21_44479552. In some embodiments, the at least three polymorphisms comprise rs9806914, imm_21_44478192, and imm_21_44479552. In some embodiments, the at least three polymorphisms are detected in the sample obtained from the subject by a process of: (a) subjecting the sample obtained from the subject to an assay configured to detect at least 10 contiguous nucleic acid molecules in at least three nucleic acid sequences within SEQ ID NOS: 1-41, or 57-59, the at least 10 contiguous nucleic acid molecules comprising a risk allele at a nucleoposition 251 or 501 within SEQ ID NOS: 1-41, or 57-59; and (b) detecting the at least 10 contiguous nucleic acid molecules in the at least three nucleic acid sequences within SEQ ID NOS: 1-41, or 57-59. In some embodiments, the assay is selected from the group consisting of polymerase chain reaction (PCR), quantitative reverse-transcription PCR (qPCR), automated sequencing, genotype array, or a combination thereof. In some embodiments, the inflammatory disease or condition is selected from the group consisting of inflammatory bowel disease (IBD), Crohn's disease (CD), obstructive CD, ulcerative colitis (UC), intestinal fibrosis, intestinal fibrostenosis, and primary sclerosing cholangitis. In some embodiments, the CD is ileal, ileocolonic, or colonic CD. In some embodiments, the subject has, or is at risk for developing, a non-response or loss-of-response to a standard therapy, the standard therapy selected from the group consisting of glucocorticosteriods, anti-TNF therapy, anti-a4-b7 therapy (vedolizumab), anti-IL12p40 therapy (ustekinumab), Thalidomide, and Cytoxan. In some embodiments, the inhibitor of TL1A is an anti-TL1A antibody or antigen-binding fragment. In some embodiments, the anti-TL1A antibody binds to the same region of human TL1A as a reference antibody, the reference antibody is selected from Table 2B. In some embodiments, the anti-TL1A antibody is a neutralizing TL1A antibody or antigen-binding fragment.

Aspects disclosed herein provide methods of selecting a subject for treatment with an inhibitor of TL1A activity or expression, the method comprising: (a) contacting a sample obtained from a subject comprising genetic material with an assay adapted to detect a presence of a genotype, the genotype comprising at least three polymorphisms provided in Table 1; and (b) selecting the subject for treatment with an inhibitor of TL1A activity or expression, provided the presence of the genotype is detected in (a). In some embodiments, methods further comprise administering or prescribing to the subject a therapeutically effective amount of the inhibitor of TL1A activity or expression. In some embodiments, methods further comprise determining whether the subject is at risk of developing a non-response or loss-of-response to a standard therapy, the standard therapy selected from the group consisting of glucocorticosteriods, anti-TNF therapy, anti-a4-b7 therapy (vedolizumab), anti-IL12p40 therapy (ustekinumab), Thalidomide, and Cytoxin. In some embodiments, the inhibitor of TL1A is an anti-TL1A antibody or antigen-binding fragment. In some embodiments, the anti-TL1A antibody binds to the same region of human TL1A as a reference antibody, the reference antibody is selected from Table 2B. In some embodiments, the anti-TL1A antibody is a neutralizing TL1A antibody or antigen-binding fragment. In some embodiments, the at least three polymorphisms is selected from the group consisting of rs11897732, rs6740739, rs17796285, rs7935393, rs12934476, rs12457255, rs2070557, rs4246905, rs10974900, rs12434976, rs16901748, rs2815844, rs889702, rs2409750, rs1541020, rs4942248, rs12934476, rs12457255, rs2297437, rs41309367, rs10733509, rs10750376, rs10932456, rs1326860, rs1528663, rs1892231, rs951279, rs9806914, rs7935393, rs1690492, rs420726, rs7759385, rs10974900, rs1326860, rs2548147, rs2815844, rs889702, rs9806914, rs6478109, rs7278257, and rs11221332. In some embodiments, a polymorphism of the at least three polymorphisms comprises a minor allele provided in Table 1. In some embodiments, a polymorphism of the at least three polymorphisms comprises a major allele provided in Table 1. In some embodiments, the genotype is heterozygous. In some embodiments, the genotype is homozygous. In some embodiments, the at least three polymorphisms are selected from the group consisting of a "G" allele at rs11897732, an "A" allele at rs6740739, a "G" allele at rs17796285, an "A" allele at rs7935393, a "G" allele at rs12934476, an "A" allele at rs12457255, an "A" allele at rs2070557, an "A" allele at rs4246905, an "A" allele at rs10974900, a "C" allele at rs12434976, an "A" allele at rs16901748, an "A" allele at rs2815844, an "A" allele at rs889702, a "C" allele at rs2409750, an "A" allele at rs1541020, a "T" allele at rs4942248, a "G" allele at rs12934476, an "A" allele at rs12457255, an "A" allele at rs2297437, a "G" allele at rs41309367, an "A" allele at rs10733509, a "G" allele at rs10750376, a "G" allele at rs10932456, an "A" allele at rs1326860, a "G" allele at rs1528663, a "C" allele at rs1892231, an "A" allele at rs951279, an "A" allele at rs9806914, an "A" allele at rs7935393, a "G" allele at rs1690492, an "A" allele at rs420726, a "T" allele at rs7759385, an "A" allele at rs10974900, an "A" allele at rs1326860, a "C" allele at rs2548147, an "A" allele at rs2815844, a "G" allele at rs889702, an "A" allele at rs9806914, an "A" allele at rs6478109, a "C" allele at rs7278257, and an "A" allele at rs11221332. In some embodiments, the at least three polymorphisms comprise imm_9_116608587, imm_11_127948309, and rs1892231. In some embodiments, the at least three polymorphisms comprise imm_9_116608587, imm_11_127948309, and rs9806914. In some embodiments, the at least three polymorphisms comprise imm_9_116608587, imm_11_127948309, and imm_21_44478192. In some embodiments, the at least three polymorphisms comprise imm_9_116608587, imm_11_127948309, and imm_21_44479552. In some embodiments, the at least three polymorphisms comprise imm_9_116608587, rs1892231, and rs9806914. In some embodiments, the at least three polymorphisms comprise imm_9_116608587, rs1892231, and imm_21_44478192. In some embodiments, the at least three polymorphisms comprise imm_9_116608587, rs1892231, and imm_21_44479552. In some embodiments, the at least three polymorphisms comprise imm_9_116608587, rs9806914, and imm_21_44478192. In some embodiments, the at least three polymorphisms comprise imm_9_116608587, rs9806914, and imm_21_44479552. In some embodiments, the at least three polymorphisms comprise imm_9_116608587, imm_21_44478192, and imm_21_44479552. In some embodiments, the at least three polymorphisms comprise imm_11_127948309, rs1892231, and rs9806914. In some embodiments, the at least three polymorphisms comprise imm_11_127948309, rs1892231, and imm_21_44478192. In some embodiments, the at least three polymorphisms comprise imm_11_127948309, rs1892231, and imm_21_44479552. In some embodiments, the at least three polymorphisms comprise imm_11_127948309, rs9806914, and imm_21_44478192. In some embodiments, the at least three polymorphisms comprise imm_11_127948309, rs9806914, and imm_21_44479552. In some embodiments, the at least three polymorphisms comprise imm_11_127948309, imm_21_44478192, and imm_21_44479552. In some embodiments, the at least three polymorphisms comprise rs1892231, rs9806914, and imm_21_44478192. In some embodiments, the at least three polymorphisms comprise rs1892231, rs9806914, and imm_21_44479552. In some embodiments, the at least three polymorphisms comprise rs1892231, imm_21_44478192, and imm_21_44479552. In some embodiments, the at least three polymorphisms comprise rs9806914, imm_21_44478192, and imm_21_44479552.

Aspects disclosed herein provide methods of treating at least one of an inflammatory, a fibrotic, and a fibrostenotic disease or condition in a subject, the method comprising: (a) determining whether a subject is, or is at risk for developing, non-response or loss-of-response to a standard therapy; (b) determining whether the subject is suitable for treatment with an inhibitor of TL1A activity or expression by a process of: (i) contacting a sample obtained from the subject with an assay adapted to detect a presence of a genotype, the genotype comprising at least three polymorphisms selected from Table 1; and (ii) detecting the genotype in the sample obtained from the subject; and (c) if the subject is not determined to have, or be at risk for developing, the non-response or loss-of-response to the standard therapy, then treating the subject by administering a therapeutically effective amount of the standard therapy to the subject; and (d) if the subject is determined to have, or be at risk for developing, the non-response or loss-of-response to the standard therapy, and the subject is determined to be suitable for treatment with the inhibitor of TL1A activity or expression, then treating the subject by administering a therapeutically effective amount of the inhibitor of TL1A activity or expression to the subject. In some embodiments, the at least three polymorphisms is selected from the group consisting of rs11897732, rs6740739, rs17796285, rs7935393, rs12934476, rs12457255, rs2070557, rs4246905, rs10974900, rs12434976, rs16901748, rs2815844, rs889702, rs2409750, rs1541020, rs4942248, rs12934476, rs12457255, rs2297437, rs41309367, rs10733509, rs10750376, rs10932456, rs1326860, rs1528663, rs1892231, rs951279, rs9806914, rs7935393, rs1690492, rs420726, rs7759385, rs10974900, rs1326860, rs2548147, rs2815844, rs889702, rs9806914, rs6478109, rs7278257, and rs11221332. In some embodiments, a polymorphism of the at least three polymorphisms comprises a minor allele provided in Table 1. In some embodiments, a polymorphism of the at least three polymorphisms comprises a major allele provided in Table 1. In some embodiments, the genotype is heterozygous. In some embodiments, the genotype is homozygous. In some embodiments, the at least three polymorphisms are selected from the group consisting of a "G" allele at rs11897732, an "A" allele at rs6740739, a "G" allele at rs17796285, an "A" allele at rs7935393, a "G" allele at rs12934476, an "A" allele at rs12457255, an "A" allele at rs2070557, an "A" allele at rs4246905, an "A" allele at rs10974900, a "C" allele at rs12434976, an "A" allele at rs16901748, an "A" allele at rs2815844, a "G" allele at rs889702, a "C" allele at rs2409750, an "A" allele at rs1541020, a "T" allele at rs4942248, a "G" allele at rs12934476, an "A" allele at rs12457255, an "A" allele at rs2297437, a "G" allele at rs41309367, an "A" allele at rs10733509, a "G" allele at rs10750376, a "G" allele at rs10932456, an "A" allele at rs1326860, a "G" allele at rs1528663, a "C" allele at rs1892231, an "A" allele at rs951279, an "A" allele at rs9806914, an "A" allele at rs7935393, a "G" allele at rs1690492, an "A" allele at rs420726, a "T" allele at rs7759385, an "A" allele at rs10974900, an "A" allele at rs1326860, a "C" allele at rs2548147, an "A" allele at rs2815844, a "G" allele at rs889702, an "A" allele at rs9806914, an "A" allele at rs6478109, a "C" allele at rs7278257, and an "A" allele at rs11221332. In some embodiments, the at least three polymorphisms comprise imm_9_116608587, imm_11_127948309, and rs1892231. In some embodiments, the at least three polymorphisms comprise imm_9_116608587, imm_11_127948309, and rs9806914. In some embodiments, the at least three polymorphisms comprise imm_9_116608587, imm_11_127948309, and imm_21_44478192. In some embodiments, the at least three polymorphisms comprise imm_9_116608587, imm_11_127948309, and imm_21_44479552. In some embodiments, the at least three polymorphisms comprise imm_9_116608587, rs1892231, and rs9806914. In some embodiments, the at least three polymorphisms comprise imm_9_116608587, rs1892231, and imm_21_44478192. In some embodiments, the at least three polymorphisms comprise imm_9_116608587, rs1892231, and imm_21_44479552. In some embodiments, the at least three polymorphisms comprise imm_9_116608587, rs9806914, and imm_21_44478192. In some embodiments, the at least three polymorphisms comprise imm_9_116608587, rs9806914, and imm_21_44479552. In some embodiments, the at least three polymorphisms comprise imm_9_116608587, imm_21_44478192, and imm_21_44479552. In some embodiments, the at least three polymorphisms comprise imm_11_127948309, rs1892231, and rs9806914. In some embodiments, the at least three polymorphisms comprise imm_11_127948309, rs1892231, and imm_21_44478192. In some embodiments, the at least three polymorphisms comprise imm_11_127948309, rs1892231, and imm_21_44479552. In some embodiments, the at least three polymorphisms comprise imm_11_127948309, rs9806914, and imm_21_44478192. In some embodiments, the at least three polymorphisms comprise imm_11_127948309, rs9806914, and imm_21_44479552. In some embodiments, the at least three polymorphisms comprise imm_11_127948309, imm_21_44478192, and imm_21_44479552. In some embodiments, the at least three polymorphisms comprise rs1892231, rs9806914, and imm_21_44478192. In some embodiments, the at least three polymorphisms comprise rs1892231, rs9806914, and imm_21_44479552. In some embodiments, the at least three polymorphisms comprise rs1892231, imm_21_44478192, and imm_21_44479552. In some embodiments, the at least three polymorphisms comprise rs9806914, imm_21_44478192, and imm_21_44479552. In some embodiments, the standard therapy is selected from the group consisting of glucocorticosteriods, anti-TNF therapy, anti-a4-b7 therapy (vedolizumab), anti-IL12p40 therapy (ustekinumab), Thalidomide, and Cytoxin.

Additional aspects and advantages of the present disclosure will become readily apparent to those skilled in this art from the following detailed description, wherein only illustrative embodiments of the present disclosure are shown and described. As will be realized, the present disclosure is capable of other and different embodiments, and its several details are capable of modifications in various obvious respects, all without departing from the disclosure. Accordingly, the drawings and description are to be regarded as illustrative in nature, and not as restrictive.

INCORPORATION BY REFERENCE

All publications, patents, and patent applications mentioned in this specification are herein incorporated by reference to the same extent as if each individual publication, patent, or patent application was specifically and individually indicated to be incorporated by reference. To the extent publications and patents or patent applications incorporated by reference contradict the disclosure contained in the specification, the specification is intended to supersede and/or take precedence over any such contradictory material.

BRIEF DESCRIPTION OF THE DRAWINGS

The novel features of the inventive concepts set forth with particularity in the appended claims. A better understanding of the features and advantages of the present invention will be obtained by reference to the following detailed description that sets forth illustrative embodiments, in which the principles of the invention are utilized, and the accompanying drawings (also "Figure" and "FIG." herein), of which:

FIG. 5A shows cluster 1, FIG. 5B shows cluster 2, and FIG. 5C shows cluster 3, from the TL1A CDx dataset.

DETAILED DESCRIPTION

Provided herein are methods, systems, and kits for identifying a subject who may be suitable for treatment with an inhibitor of Tumor Necrosis Factor (Ligand) Superfamily, Member 15 (TL1A) activity or expression, provided the subject is a carrier of a genotype. The subject may be a patient, who may be diagnosed with an inflammatory disease, a fibrostenotic disease, or a fibrotic disease, such as inflammatory bowel disease (IBD) or Crohn's disease (CD). The subject may not be a patient, but may be suspected of having the inflammatory disease, the fibrostenotic disease, or the fibrotic disease. The genotype may, in some cases, be useful for characterizing the inflammatory fibrostenotic, or fibrotic disease or condition, as mediated by TL1A. The subject, in some embodiments, is treated by administering the inhibitor of TL1A activity or expression (e.g., anti-TL1A antibody) to the subject, provided the genotype is detected. In some cases, identifying the subject as being suitable for treatment with the inhibitor of activity or expression is required in order to administer the inhibitor to the subject.

Figure 1:
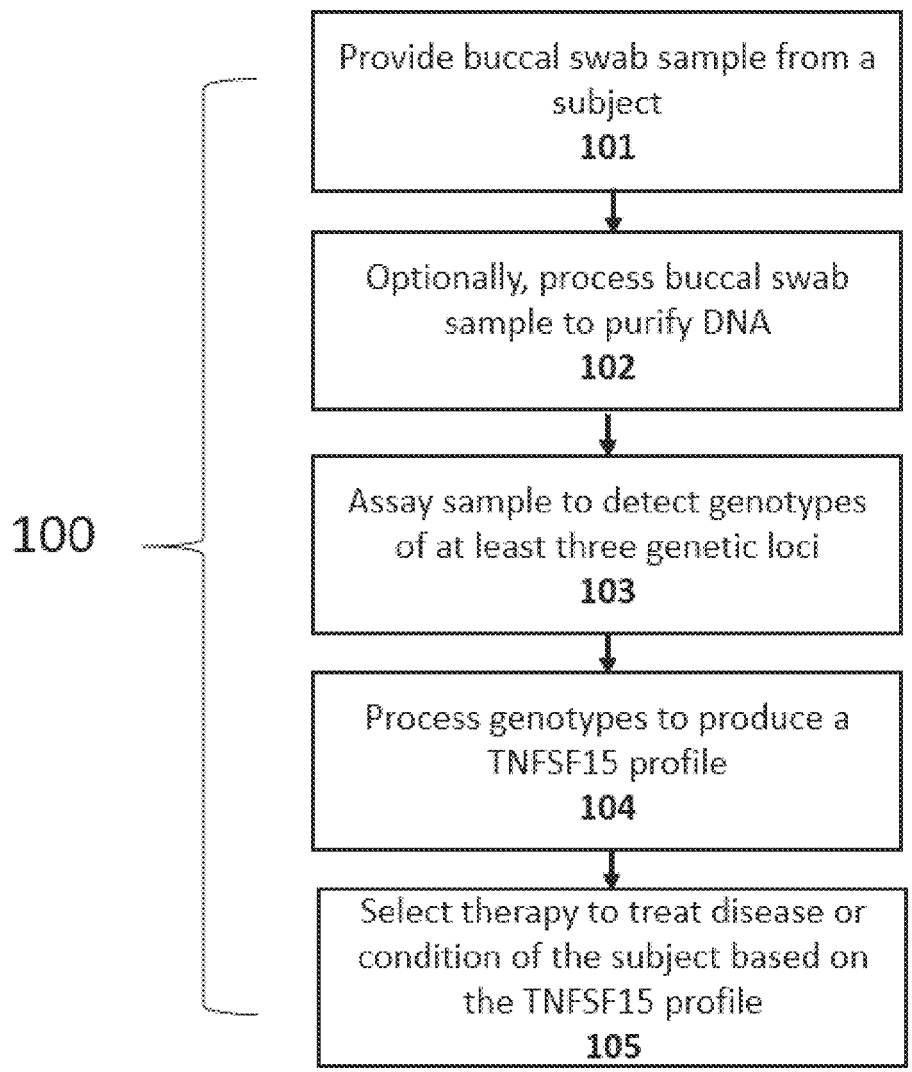
FIG. 1 shows a workflow according to an embodiment of the present disclosure for processing a biological sample obtained from a subject to inform the selection of a therapeutic agent to treat a disease or a condition of the subject.

Referring to FIG. 1, the methods, systems and kits of the present disclosure involve, in some embodiments, the steps of providing a buccal swab sample from a subject 101, optionally purifying DNA from the sample by processing the sample 102, assaying the optionally processed sample to detect genotypes of at least three genetic loci in the sample 103, processing the genotypes to produce a TNFSF15 profile 104, and selecting a therapy to treat a disease or disorder of the subject based on the TNFSF15 profile 105.

The genotypes described herein are detected using suitable genotyping devices (e.g., array, sequencing). In some instances, a sample is obtained from the subject or patient indirectly or directly. In some instances, the sample may be obtained by the subject. In other instances, the sample may be obtained by a healthcare professional, such as a nurse or physician. The sample may be derived from virtually any biological fluid or tissue containing genetic information, such as blood.

The subject disclosed herein can be a mammal, such as for example a mouse, rat, guinea pig, rabbit, non-human primate, or farm animal. In some instances, the subject is human. In some instances, the subject is suffering from a symptom related to a disease or condition disclosed herein (e.g., abdominal pain, cramping, diarrhea, rectal bleeding, fever, weight loss, fatigue, loss of appetite, dehydration, and malnutrition, anemia, or ulcers).

In some embodiments, the subject is susceptible to, or is inflicted with, thiopurine toxicity, or a disease caused by thiopurine toxicity (such as pancreatitis or leukopenia). The subject may experience, or is suspected of experiencing, non-response or loss-of-response to a standard treatment (e.g., anti-TNF alpha therapy, anti-a4-b7 therapy (vedolizumab), anti-IL12p40 therapy (ustekinumab), Thalidomide, or Cytoxin).

The disease or condition disclosed herein may be an inflammatory disease, a fibrostenotic disease, or a fibrotic disease. In some instances, the disease or the condition is a TL1A-mediated disease or condition. The term, "TL1A-mediated disease or condition" refers to a disease or a condition pathology or pathogenesis that is driven, at least in part, by TL1A signaling. In some instances, the disease or the condition is immune-mediated disease or condition, such as those mediated by TL1A.

In some embodiments the disease or the condition is an inflammatory disease or disorder that is mediated, at least in part, by TL1A signaling. Non-limiting examples of inflammatory disease include, allergy, ankylosing spondylitis, asthma, atopic dermatitis, autoimmune diseases or disorders, cancer, celiac disease, chronic obstructive pulmonary disease (COPD), chronic peptic ulcer, cystic fibrosis, diabetes (e.g., type 1 diabetes and type 2 diabetes), glomerulonephritis, gout, hepatitis (e.g., active hepatitis), an immune-mediated disease or disorder, inflammatory bowel disease (IBD) such as Crohn's disease and ulcerative colitis, myositis, osteoarthritis, pelvic inflammatory disease (PID), multiple sclerosis, neurodegenerative diseases of aging, periodontal disease (e.g., periodontitis), preperfusion injury transplant rejection, psoriasis, pulmonary fibrosis, rheumatic disease, scleroderma, sinusitis, tuberculosis.

In some embodiments, the disease or the condition is an autoimmune disease that is mediated, at least in part, by TL1A signaling. Non-limiting examples of autoimmune disease or disorder include Achalasia, Addison's disease, Adult Still's disease, Agammaglobulinemia, Alopecia areata, Amyloidosis, Ankylosing spondylitis, Anti-GBM/Anti-TBM nephritis, Antiphospholipid syndrome, Autoimmune angioedema, Autoimmune dysautonomia, Autoimmune encephalomyelitis, Autoimmune hepatitis, Autoimmune inner ear disease (AIED), Autoimmune myocarditis, Autoimmune oophoritis, Autoimmune orchitis, Autoimmune pancreatitis, Autoimmune retinopathy, Autoimmune urticaria, Axonal & neuronal neuropathy (AMAN), Baló disease, Behcet's disease, Benign mucosal pemphigoid, Bullous pemphigoid, Castleman disease (CD), Celiac disease, Chagas disease, Chronic inflammatory demyelinating polyneuropathy (CIDP), Chronic recurrent multifocal osteomyelitis (CRMO), Churg-Strauss Syndrome (CSS) or Eosinophilic Granulomatosis (EGPA), Cicatricial pemphigoid, Cogan's syndrome, Cold agglutinin disease, Congenital heart block, Coxsackie myocarditis, CREST syndrome, Crohn's disease, Dermatitis herpetiformis, Dermatomyositis, Devic's disease (neuromyelitis optica), Discoid lupus, Dressler's syndrome, Endometriosis, Eosinophilic esophagitis (EoE), Eosinophilic fasciitis, Erythema nodosum, Essential mixed cryoglobulinemia, Evans syndrome, Fibromyalgia, Fibrosing alveolitis, Giant cell arteritis (temporal arteritis), Giant cell myocarditis, Glomerulonephritis, Goodpasture's syndrome, Granulomatosis with Polyangiitis, Graves' disease, Guillain-Barre syndrome, Hashimoto's thyroiditis, Hemolytic anemia, Henoch-Schonlein purpura (HSP), Herpes gestationis or pemphigoid gestationis (PG), Hidradenitis Suppurativa (HS) (Acne Inversa), Hypogammalglobulinemia, IgA Nephropathy, IgG4-related sclerosing disease, Immune thrombocytopenic purpura (ITP), Inclusion body myositis (IBM), Interstitial cystitis (IC), Juvenile arthritis, Juvenile diabetes (Type 1 diabetes), Juvenile myositis (JM), Kawasaki disease, Lambert-Eaton syndrome, Leukocytoclastic vasculitis, Lichen planus, Lichen sclerosus, Ligneous conjunctivitis, Linear IgA disease (LAD), Lupus, Lyme disease chronic, Meniere's disease, Microscopic polyangiitis (MPA), Mixed connective tissue disease (MCTD), Mooren's ulcer, Mucha-Habermann disease, Multifocal Motor Neuropathy (MMN) or MMNCB, Multiple sclerosis, Myasthenia gravis, Myositis, Narcolepsy, Neonatal Lupus, Neuromyelitis optica, Neutropenia, Ocular cicatricial pemphigoid, Optic neuritis, Palindromic rheumatism (PR), PANDAS, Paraneoplastic cerebellar degeneration (PCD), Paroxysmal nocturnal hemoglobinuria (PNH), Parry Romberg syndrome, Pars planitis (peripheral uveitis), Parsonage-Turner syndrome, Pemphigus, Peripheral neuropathy, Perivenous encephalomyelitis, Pernicious anemia (PA), POEMS syndrome, Polyarteritis nodosa, Polyglandular syndromes type I, II, III, Polymyalgia rheumatica, Polymyositis, Postmyocardial infarction syndrome, Postpericardiotomy syndrome, Primary biliary cirrhosis, Primary sclerosing cholangitis, Progesterone dermatitis, Psoriasis, Psoriatic arthritis, Pure red cell aplasia (PRCA), Pyoderma gangrenosum, Raynaud's phenomenon, Reactive Arthritis, Reflex sympathetic dystrophy, Relapsing polychondritis, Restless legs syndrome (RLS), Retroperitoneal fibrosis, Rheumatic fever, Rheumatoid arthritis, Sarcoidosis, Schmidt syndrome, Scleritis, Scleroderma, Sjögren's syndrome, Sperm & testicular autoimmunity, Stiff person syndrome (SPS), Subacute bacterial endocarditis (SBE), Susac's syndrome, Sympathetic ophthalmia (SO), Takayasu's arteritis, Temporal arteritis/Giant cell arteritis, Thrombocytopenic purpura (TTP), Tolosa-Hunt syndrome (THS), Transverse myelitis, Type 1 diabetes, Ulcerative colitis (UC), Undifferentiated connective tissue disease (UCTD), Uveitis, Vasculitis, Vitiligo, and Vogt-Koyanagi-Harada Disease.

In some embodiments, the disease or the condition is a cancer that is mediated, at least in part, by TL1A signaling. Non-limiting examples of cancers include Adenoid Cystic Carcinoma, Adrenal Gland Cancer, Amyloidosis, Anal Cancer, Ataxia-Telangiectasia, Atypical Mole Syndrome, Basal Cell Carcinoma, Bile Duct Cancer, Birt Hogg Dube Syndrome, Bladder Cancer, Bone Cancer, Brain Tumor, Breast Cancer, Breast Cancer in Men, Carcinoid Tumor, Cervical Cancer, Colorectal Cancer, Ductal Carcinoma, Endometrial Cancer, Esophageal Cancer, Gastric Cancer, Gastrointestinal Stromal Tumor (GIST), HER2-Positive Breast Cancer, Islet Cell Tumor, Juvenile Polyposis Syndrome, Kidney Cancer, Laryngeal Cancer, Leukemia—Acute Lymphoblastic Leukemia, Leukemia—Acute Lymphocytic (ALL), Leukemia—Acute Myeloid AML, Leukemia—Adult, Leukemia—Childhood, Leukemia—Chronic Lymphocytic (CLL), Leukemia—Chronic Myeloid (CML), Liver Cancer, Lobular Carcinoma, Lung Cancer, Lung Cancer—Small Cell (SCLC), Lung Cancer—Non-small Cell (NSCLC), Lymphoma—Hodgkin's, Lymphoma—Non-Hodgkin's, Malignant Glioma, Melanoma, Meningioma, Multiple Myeloma, Myelodysplastic Syndrome (MDS), Nasopharyngeal Cancer, Neuroendocrine Tumor, Oral Cancer, Osteosarcoma, Ovarian Cancer, Pancreatic Cancer, Pancreatic Neuroendocrine Tumors, Parathyroid Cancer, Penile Cancer, Peritoneal Cancer, Peutz-Jeghers Syndrome, Pituitary Gland Tumor, Polycythemia Vera, Prostate Cancer, Renal Cell Carcinoma, Retinoblastoma, Salivary Gland Cancer, Sarcoma, Sarcoma—Kaposi, Skin Cancer, Small Intestine Cancer, Stomach Cancer, Testicular Cancer, Thymoma, Thyroid Cancer, Uterine (Endometrial) Cancer, Vaginal Cancer, and Wilms' Tumor.

In some embodiments, the disease or the condition is an inflammatory bowel disease, such as Crohn's disease (CD) or ulcerative colitis (UC). A subject may suffer from fibrosis, fibrostenosis, or a fibrotic disease, either isolated or in combination with an inflammatory disease. In some cases, the CD is severe CD. The severe CD may result from inflammation that has led to the formation of scar tissue in the intestinal wall (fibrostenosis) and/or swelling. In some cases, the severe CD is characterized by the presence of fibrotic and/or inflammatory strictures. The strictures may be determined by computed tomography enterography (CTE), and magnetic resonance imaging enterography (MRE). The disease or condition may be characterized as refractory, which in some cases, means the disease is resistant to a standard treatment (e.g., anti-TNFα therapy). Non-limiting examples of standard treatment include glucocorticosteriods, anti-TNF therapy, anti-a4-b7 therapy (vedolizumab), anti-IL12p40 therapy (ustekinumab), Thalidomide, and Cytoxin.

Genotypes

Disclosed herein are genotypes that may be detected in a sample obtained from a subject by analyzing the genetic material in the sample. In some instances, the subject may be human. In some embodiments, the genetic material is obtained from a subject having a disease or condition disclosed herein. In some cases, the genetic material is obtained from blood, serum, plasma, sweat, hair, tears, urine, and other techniques known by one of skill in the art. In some cases, the genetic material is obtained from a biopsy, e.g., from the intestinal track of the subject.

The genotypes of the present disclosure comprise genetic material that is deoxyribonucleic acid (DNA). In some instances, the genotype comprises a denatured DNA molecule or fragment thereof. In some instances, the genotype comprises DNA selected from: genomic DNA, viral DNA, mitochondrial DNA, plasmid DNA, amplified DNA, circular DNA, circulating DNA, cell-free DNA, or exosomal DNA. In some instances, the DNA is single-stranded DNA (ssDNA), double-stranded DNA, denaturing double-stranded DNA, synthetic DNA, and combinations thereof. The circular DNA may be cleaved or fragmented.

The genotypes disclosed herein comprise at least one polymorphism at a gene or genetic locus described herein. In some instances, the gene or genetic locus is selected from the group consisting of Tumor Necrosis Factor (Ligand) Superfamily, Member 15 (TNFSF15), THADA Armadillo Repeat Containing (THADA), Pleckstrin Homology, MyTH4 And FERM Domain Containing H2 (PLEKHH2), XK Related 6 (XKR6), Myotubularin Related Protein 9 (MTMR9), ETS Proto-Oncogene 1, Transcription Factor (ETS1), C-Type Lectin Domain Containing 16A (CLEC16A), Suppressor Of Cytokine Signaling 1 (SOCS1), Protein Tyrosine Phosphatase Non-Receptor Type 2 (PTPN2), Inducible T Cell Costimulator Ligand (ICOSLG), Janus Kinase 2 (JAK2), Catenin Delta 2 (CTNND2), Regulator Of G Protein Signaling 7 (RGS7), RNA Binding Fox-1 Homolog 1 (RBFOX1), RNA Binding Motif Protein 17 (RBM17), 6-Phosphofructo-2-Kinase/Fructose-2,6-Biphosphatase 3 (PFKFB3), Ecto-NOX Disulfide-Thiol Exchanger 1 (ENOX1), Coiled-Coil Domain Containing 122 (CCDC122), Regulator Of Telomere Elongation Helicase 1 (RTEL1), TNF Receptor Superfamily Member 6b (TNFRSF6B), GLIS Family Zinc Finger 3 (GLIS3), Solute Carrier Family 1 Member 1 (SLC1A1), IKAROS Family Zinc Finger 2 (IKZF2), Fatty Acyl-CoA Reductase 1 (FAR1), Spondin 1(SPON1), Plexin A2 (PLXNA2), MIR205 Host Gene (MIR205HG), C-Type Lectin Domain Containing 16A (CLEC16A), PR/SET Domain 14 (PRDM), Autophagy Related 5 (ATG5), and Prostaglandin E Receptor 4 (PTGER4). In some instances, the gene or genetic locus comprises a gene or genetic locus provided in Table 1. The genotypes disclosed herein are, in some cases, a haplotype. In some instances, the genotype comprises a particular polymorphism, a polymorphism in linkage disequilibrium (LD) therewith, or a combination thereof. In some cases, LD is defined by an $r^2$ of at least or about 0.70, 0.75, 0.80, 0.85, 0.90, or 1.0. The genotypes disclosed herein can comprise at least or about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more polymorphisms. In preferred embodiments, the genotypes disclosed herein comprise a combination of 3 polymorphisms, such as those provided in Table 1.

The polymorphisms described herein can be a single nucleotide polymorphism, or an indel (insertion/deletion). In some instances, the polymorphism is an insertion or a deletion of at least one nucleobase (e.g., an indel). In some instances, the genotype may comprise a copy number variation (CNV), which is a variation in a number of a nucleic acid sequence between individuals in a given population. In some instances, the CNV comprises at least or about two, three, four, five, six, seven, eight, nine, ten, twenty, thirty, forty or fifty nucleic acid molecules. In some instances, the genotype is heterozygous. In some instances, the genotype is homozygous.

Disclosed herein, in the following embodiments, are genotypes disclosed herein:

1. A genotype comprising at least one polymorphism at a gene or genetic locus.
2. The genotype of embodiment 1 comprising a polymorphism provided in Table 1.
3. The genotype of embodiments 1-2 that is heterozygous.
4. The genotype of embodiments 1-2 that is homozygous.
5. The genotype of embodiments 1-4, wherein the genotype comprises at least two polymorphisms.
6. The genotype of embodiments 1-4, wherein the genotype comprises at least three polymorphisms.
7. The genotype of embodiments 1-4, wherein the genotype comprises at least four polymorphisms.
8. The genotype of embodiment 1, comprising a polymorphism in linkage disequilibrium with a polymorphism provided in Table 1.
9. The genotype of embodiment 8, wherein LD is defined by (i) a D' value of at least about 0.70, or (ii) a D' value of 0 and an $r^2$ value of at least about 0.70.
10. The genotype of embodiment 8, wherein LD is defined by (i) a D' value of at least about 0.80, or (ii) a D' value of 0 and an $r^2$ value of at least about 0.80.
11. The genotype of embodiment 8, wherein LD is defined by (i) a D' value of at least about 0.90, or (ii) a D' value of 0 and an $r^2$ value of at least about 0.90.
12. The genotype of embodiment 8, wherein LD is defined by (i) a D' value of at least about 0.95, or (ii) a D' value of 0 and an $r^2$ value of at least about 0.95.
13. The genotype of embodiments 1-12, wherein the gene or genetic locus is selected from the group consisting of Tumor Necrosis Factor (Ligand) Superfamily, Member 15 (TNFSF15), THADA Armadillo Repeat Containing (THADA), Pleckstrin Homology, MyTH4 And FERM Domain Containing H2 (PLEKHH2), XK Related 6 (XKR6), Myotubularin Related Protein 9 (MTMR9), ETS Proto-Oncogene 1, Transcription Factor (ETS1), C-Type Lectin Domain Containing 16A (CLEC16A), Suppressor Of Cytokine Signaling 1 (SOCS1), Protein Tyrosine Phosphatase Non-Receptor Type 2 (PTPN2), Inducible T Cell Costimulator Ligand (ICOSLG), Janus Kinase 2 (JAK2), Catenin Delta 2 (CTNND2), Regulator Of G Protein Signaling 7 (RGS7), RNA Binding Fox-1 Homolog 1 (RBFOX1), RNA Binding Motif Protein 17 (RBM17), 6-Phosphofructo-2-Kinase/Fructose-2,6-Biphosphatase 3 (PFKFB3), Ecto-NOX Disulfide-Thiol Exchanger 1 (ENOX1), Coiled-Coil Domain Containing 122 (CCDC122), Regulator Of Telomere Elongation Helicase 1 (RTEL1), TNF Receptor Superfamily Member 6b (TNFRSF6B), GLIS Family Zinc Finger 3 (GLIS3), Solute Carrier Family 1 Member 1 (SLC1A1), IKAROS Family Zinc Finger 2 (IKZF2), Fatty Acyl-CoA Reductase 1 (FAR1), Spondin 1(SPON1), Plexin A2 (PLXNA2), MIR205 Host Gene (MIR205HG), C-Type Lectin Domain Containing 16A (CLEC16A), PR/SET Domain 14 (PRDM), Autophagy Related 5 (ATG5), and Prostaglandin E Receptor 4 (PTGER4).

14. The genotype of embodiments 5-6, wherein the genotype comprises at least two polymorphisms selected from:
(1) rs16901748, rs7759385, rs4246905;
(2) rs16901748, rs7759385, rs7935393;
(3) rs16901748, rs7759385, rs1892231;
(4) rs16901748, rs7759385, rs12934476;
(5) rs16901748, rs7759385, rs9806914;
(6) rs16901748, rs7759385, rs2297437;
(7) rs16901748, rs7759385, rs2070557;
(8) rs16901748, rs7759385, rs7278257;
(9) rs16901748, rs7759385, rs11221332;
(10) rs16901748, rs7759385, rs41309367;
(11) rs16901748, rs7759385, rs6478109;
(12) rs16901748, rs4246905, rs7935393;
(13) rs16901748, rs4246905, rs1892231;
(14) rs16901748, rs4246905, rs12934476;
(15) rs16901748, rs4246905, rs9806914;
(16) rs16901748, rs4246905, rs2297437;
(17) rs16901748, rs4246905, rs2070557;
(18) rs16901748, rs4246905, rs7278257;
(19) rs16901748, rs4246905, rs11221332;
(20) rs16901748, rs4246905, rs41309367;
(21) rs16901748, rs4246905, rs6478109;
(22) rs16901748, rs7935393, rs1892231;
(23) rs16901748, rs7935393, rs12934476;
(24) rs16901748, rs7935393, rs9806914;
(25) rs16901748, rs7935393, rs2297437;
(26) rs16901748, rs7935393, rs2070557;
(27) rs16901748, rs7935393, rs7278257;
(28) rs16901748, rs7935393, rs11221332;
(29) rs16901748, rs7935393, rs41309367;
(30) rs16901748, rs7935393, rs6478109;
(31) rs16901748, rs1892231, rs12934476;
(32) rs16901748, rs1892231, rs9806914;
(33) rs16901748, rs1892231, rs2297437;
(34) rs16901748, rs1892231, rs2070557;
(35) rs16901748, rs1892231, rs7278257;
(36) rs16901748, rs1892231, rs11221332;
(37) rs16901748, rs1892231, rs41309367;
(38) rs16901748, rs1892231, rs6478109;
(39) rs16901748, rs12934476, rs9806914;
(40) rs16901748, rs12934476, rs2297437;
(41) rs16901748, rs12934476, rs2070557;
(42) rs16901748, rs12934476, rs7278257;
(43) rs16901748, rs12934476, rs11221332;
(44) rs16901748, rs12934476, rs41309367;
(45) rs16901748, rs12934476, rs6478109;
(46) rs16901748, rs9806914, rs2297437;
(47) rs16901748, rs9806914, rs2070557;
(48) rs16901748, rs9806914, rs7278257;
(49) rs16901748, rs9806914, rs11221332;
(50) rs16901748, rs9806914, rs41309367;
(51) rs16901748, rs9806914, rs6478109;
(52) rs16901748, rs2297437, rs2070557;
(53) rs16901748, rs2297437, rs7278257;
(54) rs16901748, rs2297437, rs11221332;
(55) rs16901748, rs2297437, rs41309367;
(56) rs16901748, rs2297437, rs6478109;
(57) rs16901748, rs2070557, rs7278257;
(58) rs16901748, rs2070557, rs11221332;
(59) rs16901748, rs2070557, rs41309367;
(60) rs16901748, rs2070557, rs6478109;
(61) rs16901748, rs7278257, rs11221332;
(62) rs16901748, rs7278257, rs41309367;
(63) rs16901748, rs7278257, rs6478109;
(64) rs16901748, rs11221332, rs41309367;
(65) rs16901748, rs11221332, rs6478109;
(66) rs16901748, rs41309367, rs6478109;
(67) rs7759385, rs4246905, rs7935393;
(68) rs7759385, rs4246905, rs1892231;
(69) rs7759385, rs4246905, rs12934476;
(70) rs7759385, rs4246905, rs9806914;
(71) rs7759385, rs4246905, rs2297437;
(72) rs7759385, rs4246905, rs2070557;
(73) rs7759385, rs4246905, rs7278257;
(74) rs7759385, rs4246905, rs11221332;
(75) rs7759385, rs4246905, rs41309367;
(76) rs7759385, rs4246905, rs6478109;
(77) rs7759385, rs7935393, rs1892231;
(78) rs7759385, rs7935393, rs12934476;
(79) rs7759385, rs7935393, rs9806914;
(80) rs7759385, rs7935393, rs2297437;
(81) rs7759385, rs7935393, rs2070557;
(82) rs7759385, rs7935393, rs7278257;
(83) rs7759385, rs7935393, rs11221332;
(84) rs7759385, rs7935393, rs41309367;
(85) rs7759385, rs7935393, rs6478109;
(86) rs7759385, rs1892231, rs12934476;
(87) rs7759385, rs1892231, rs9806914;
(88) rs7759385, rs1892231, rs2297437;
(89) rs7759385, rs1892231, rs2070557;
(90) rs7759385, rs1892231, rs7278257;
(91) rs7759385, rs1892231, rs11221332;
(92) rs7759385, rs1892231, rs41309367;
(93) rs7759385, rs1892231, rs6478109;
(94) rs7759385, rs12934476, rs9806914;
(95) rs7759385, rs12934476, rs2297437;
(96) rs7759385, rs12934476, rs2070557;
(97) rs7759385, rs12934476, rs7278257;
(98) rs7759385, rs12934476, rs11221332;
(99) rs7759385, rs12934476, rs41309367;
(100) rs7759385, rs12934476, rs6478109;
(101) rs7759385, rs9806914, rs2297437;
(102) rs7759385, rs9806914, rs2070557;
(103) rs7759385, rs9806914, rs7278257;
(104) rs7759385, rs9806914, rs11221332;
(105) rs7759385, rs9806914, rs41309367;
(106) rs7759385, rs9806914, rs6478109;
(107) rs7759385, rs2297437, rs2070557;
(108) rs7759385, rs2297437, rs7278257;

(109) rs7759385, rs2297437, rs11221332;
(110) rs7759385, rs2297437, rs41309367;
(111) rs7759385, rs2297437, rs6478109;
(112) rs7759385, rs2070557, rs7278257;
(113) rs7759385, rs2070557, rs11221332;
(114) rs7759385, rs2070557, rs41309367;
(115) rs7759385, rs2070557, rs6478109;
(116) rs7759385, rs7278257, rs11221332;
(117) rs7759385, rs7278257, rs41309367;
(118) rs7759385, rs7278257, rs6478109;
(119) rs7759385, rs11221332, rs41309367;
(120) rs7759385, rs11221332, rs6478109;
(121) rs7759385, rs41309367, rs6478109;
(122) rs4246905, rs7935393, rs1892231;
(123) rs4246905, rs7935393, rs12934476;
(124) rs4246905, rs7935393, rs9806914;
(125) rs4246905, rs7935393, rs2297437;
(126) rs4246905, rs7935393, rs2070557;
(127) rs4246905, rs7935393, rs7278257;
(128) rs4246905, rs7935393, rs11221332;
(129) rs4246905, rs7935393, rs41309367;
(130) rs4246905, rs7935393, rs6478109;
(131) rs4246905, rs1892231, rs12934476;
(132) rs4246905, rs1892231, rs9806914;
(133) rs4246905, rs1892231, rs2297437;
(134) rs4246905, rs1892231, rs2070557;
(135) rs4246905, rs1892231, rs7278257;
(136) rs4246905, rs1892231, rs11221332;
(137) rs4246905, rs1892231, rs41309367;
(138) rs4246905, rs1892231, rs6478109;
(139) rs4246905, rs12934476, rs9806914;
(140) rs4246905, rs12934476, rs2297437;
(141) rs4246905, rs12934476, rs2070557;
(142) rs4246905, rs12934476, rs7278257;
(143) rs4246905, rs12934476, rs11221332;
(144) rs4246905, rs12934476, rs41309367;
(145) rs4246905, rs12934476, rs6478109;
(146) rs4246905, rs9806914, rs2297437;
(147) rs4246905, rs9806914, rs2070557;
(148) rs4246905, rs9806914, rs7278257;
(149) rs4246905, rs9806914, rs11221332;
(150) rs4246905, rs9806914, rs41309367;
(151) rs4246905, rs9806914, rs6478109;
(152) rs4246905, rs2297437, rs2070557;
(153) rs4246905, rs2297437, rs7278257;
(154) rs4246905, rs2297437, rs11221332;
(155) rs4246905, rs2297437, rs41309367;
(156) rs4246905, rs2297437, rs6478109;
(157) rs4246905, rs2070557, rs7278257;
(158) rs4246905, rs2070557, rs11221332;
(159) rs4246905, rs2070557, rs41309367;
(160) rs4246905, rs2070557, rs6478109;
(161) rs4246905, rs7278257, rs11221332;
(162) rs4246905, rs7278257, rs41309367;
(163) rs4246905, rs7278257, rs6478109;
(164) rs4246905, rs11221332, rs41309367;
(165) rs4246905, rs11221332, rs6478109;
(166) rs4246905, rs41309367, rs6478109;
(167) rs7935393, rs1892231, rs12934476;
(168) rs7935393, rs1892231, rs9806914;
(169) rs7935393, rs1892231, rs2297437;
(170) rs7935393, rs1892231, rs2070557;
(171) rs7935393, rs1892231, rs7278257;
(172) rs7935393, rs1892231, rs11221332;
(173) rs7935393, rs1892231, rs41309367;
(174) rs7935393, rs1892231, rs6478109;
(175) rs7935393, rs12934476, rs9806914;
(176) rs7935393, rs12934476, rs2297437;
(177) rs7935393, rs12934476, rs2070557;
(178) rs7935393, rs12934476, rs7278257;
(179) rs7935393, rs12934476, rs11221332;
(180) rs7935393, rs12934476, rs41309367;
(181) rs7935393, rs12934476, rs6478109;
(182) rs7935393, rs9806914, rs2297437;
(183) rs7935393, rs9806914, rs2070557;
(184) rs7935393, rs9806914, rs7278257;
(185) rs7935393, rs9806914, rs11221332;
(186) rs7935393, rs9806914, rs41309367;
(187) rs7935393, rs9806914, rs6478109;
(188) rs7935393, rs2297437, rs2070557;
(189) rs7935393, rs2297437, rs7278257;
(190) rs7935393, rs2297437, rs11221332;
(191) rs7935393, rs2297437, rs41309367;
(192) rs7935393, rs2297437, rs6478109;
(193) rs7935393, rs2070557, rs7278257;
(194) rs7935393, rs2070557, rs11221332;
(195) rs7935393, rs2070557, rs41309367;
(196) rs7935393, rs2070557, rs6478109;
(197) rs7935393, rs7278257, rs11221332;
(198) rs7935393, rs7278257, rs41309367;
(199) rs7935393, rs7278257, rs6478109;
(200) rs7935393, rs11221332, rs4130936; 7
(201) rs7935393, rs11221332, rs6478109;
(202) rs7935393, rs41309367, rs6478109;
(203) rs1892231, rs12934476, rs9806914;
(204) rs1892231, rs12934476, rs2297437;
(205) rs1892231, rs12934476, rs2070557;
(206) rs1892231, rs12934476, rs7278257;
(207) rs1892231, rs12934476, rs11221332;
(208) rs1892231, rs12934476, rs41309367;
(209) rs1892231, rs12934476, rs6478109;
(210) rs1892231, rs9806914, rs2297437;
(211) rs1892231, rs9806914, rs2070557;
(212) rs1892231, rs9806914, rs7278257;
(213) rs1892231, rs9806914, rs11221332;
(214) rs1892231, rs9806914, rs41309367;
(215) rs1892231, rs9806914, rs6478109;
(216) rs1892231, rs2297437, rs2070557;
(217) rs1892231, rs2297437, rs7278257;
(218) rs1892231, rs2297437, rs11221332;
(219) rs1892231, rs2297437, rs41309367;
(220) rs1892231, rs2297437, rs6478109;
(221) rs1892231, rs2070557, rs7278257;
(222) rs1892231, rs2070557, rs11221332;
(223) rs1892231, rs2070557, rs41309367;
(224) rs1892231, rs2070557, rs6478109;
(225) rs1892231, rs7278257, rs11221332;
(226) rs1892231, rs7278257, rs41309367;
(227) rs1892231, rs7278257, rs6478109;
(228) rs1892231, rs11221332, rs41309367;
(229) rs1892231, rs11221332, rs6478109;
(230) rs1892231, rs41309367, rs6478109;
(231) rs12934476, rs9806914, rs2297437;
(232) rs12934476, rs9806914, rs2070557;
(233) rs12934476, rs9806914, rs7278257;
(234) rs12934476, rs9806914, rs11221332;
(235) rs12934476, rs9806914, rs41309367;
(236) rs12934476, rs9806914, rs6478109;
(237) rs12934476, rs2297437, rs2070557;
(238) rs12934476, rs2297437, rs7278257;
(239) rs12934476, rs2297437, rs11221332;
(240) rs12934476, rs2297437, rs41309367;
(241) rs12934476, rs2297437, rs6478109;
(242) rs12934476, rs2070557, rs7278257;

(243) rs12934476, rs2070557, rs11221332;
(244) rs12934476, rs2070557, rs41309367;
(245) rs12934476, rs2070557, rs6478109;
(246) rs12934476, rs7278257, rs11221332;
(247) rs12934476, rs7278257, rs41309367;
(248) rs12934476, rs7278257, rs6478109;
(249) rs12934476, rs11221332, rs41309367;
(250) rs12934476, rs11221332, rs6478109;
(251) rs12934476, rs41309367, rs6478109;
(252) rs9806914, rs2297437, rs2070557;
(253) rs9806914, rs2297437, rs7278257;
(254) rs9806914, rs2297437, rs11221332;
(255) rs9806914, rs2297437, rs41309367;
(256) rs9806914, rs2297437, rs6478109;
(257) rs9806914, rs2070557, rs7278257;
(258) rs9806914, rs2070557, rs11221332;
(259) rs9806914, rs2070557, rs41309367;
(260) rs9806914, rs2070557, rs6478109;
(261) rs9806914, rs7278257, rs11221332;
(262) rs9806914, rs7278257, rs41309367;
(263) rs9806914, rs7278257, rs6478109;
(264) rs9806914, rs11221332, rs41309367;
(265) rs9806914, rs11221332, rs6478109;
(266) rs9806914, rs41309367, rs6478109;
(267) rs2297437, rs2070557, rs7278257;
(268) rs2297437, rs2070557, rs11221332;
(269) rs2297437, rs2070557, rs41309367;
(270) rs2297437, rs2070557, rs6478109;
(271) rs2297437, rs7278257, rs11221332;
(272) rs2297437, rs7278257, rs41309367;
(273) rs2297437, rs7278257, rs6478109;
(274) rs2297437, rs11221332, rs41309367;
(275) rs2297437, rs11221332, rs6478109;
(276) rs2297437, rs41309367, rs6478109;
(277) rs2070557, rs7278257, rs11221332;
(278) rs2070557, rs7278257, rs41309367;
(279) rs2070557, rs7278257, rs6478109;
(280) rs2070557, rs11221332, rs41309367;
(281) rs2070557, rs11221332, rs6478109;
(282) rs2070557, rs41309367, rs6478109;
(283) rs7278257, rs11221332, rs41309367;
(284) rs7278257, rs11221332, rs6478109;
(285) rs7278257, rs41309367, rs6478109; or
(286) rs11221332, rs41309367, rs6478109.
15. The genotype of embodiment 14, wherein the rs7278257 is replaced with rs56124762.
16. The genotype of embodiment 14, wherein the rs7278257 is replaced with rs2070558.
17. The genotype of embodiment 14, wherein the rs7278257 is replaced with rs2070561.
18. The genotype of embodiments 5-6, wherein the genotype comprises at least two polymorphisms selected from imm_9_116608587, imm_11_127948309, and rs1892231.
19. The genotype of embodiments 5-6, wherein the genotype comprises at least two polymorphisms selected from imm_9_116608587, imm_11_127948309, and rs9806914.
20. The genotype of embodiments 5-6, wherein the genotype comprises at least two polymorphisms selected from imm_9_116608587, imm_11_127948309, and imm_21_44478192.
21. The genotype of embodiments 5-6, wherein the genotype comprises at least two polymorphisms selected from imm_9_116608587, imm_11_127948309, and imm_21_44479552.
22. The genotype of embodiments 5-6, wherein the genotype comprises at least two polymorphisms selected from imm_9_116608587, rs1892231, and rs9806914.
23. The genotype of embodiments 5-6, wherein the genotype comprises at least two polymorphisms selected from imm_9_116608587, rs1892231, and imm_21_44478192.
24. The genotype of embodiments 5-6, wherein the genotype comprises at least two polymorphisms selected from imm_9_116608587, rs1892231, and imm_21_44479552.
25. The genotype of embodiments 5-6, wherein the genotype comprises at least two polymorphisms selected from imm_9_116608587, rs9806914, and imm_21_44478192.
26. The genotype of embodiments 5-6, wherein the genotype comprises at least two polymorphisms selected from imm_9_116608587, rs9806914, and imm_21_44479552.
27. The genotype of embodiments 5-6, wherein the genotype comprises at least two polymorphisms selected from imm_9_116608587, imm_21_44478192, and imm_21_44479552.
28. The genotype of embodiments 5-6, wherein the genotype comprises at least two polymorphisms selected from imm_11_127948309, rs1892231, and rs9806914.
29. The genotype of embodiments 5-6, wherein the genotype comprises at least two polymorphisms selected from imm_11_127948309, rs1892231, and imm_21_44478192.
30. The genotype of embodiments 5-6, wherein the genotype comprises at least two polymorphisms selected from imm_11_127948309, rs1892231, and imm_21_44479552.
31. The genotype of embodiments 5-6, wherein the genotype comprises at least two polymorphisms selected from imm_11_127948309, rs9806914, and imm_21_44478192.
32. The genotype of embodiments 5-6, wherein the genotype comprises at least two polymorphisms selected from imm_11_127948309, rs9806914, and imm_21_44479552.
33. The genotype of embodiments 5-6, wherein the genotype comprises at least two polymorphisms selected from imm_11_127948309, imm_21_44478192, and imm_21_44479552.
34. The genotype of embodiments 5-6, wherein the genotype comprises at least two polymorphisms selected from rs1892231, rs9806914, and imm_21_44478192.
35. The genotype of embodiments 5-6, wherein the genotype comprises at least two polymorphisms selected from rs1892231, rs9806914, and imm_21_44479552.
36. The genotype of embodiments 5-6, wherein the genotype comprises at least two polymorphisms selected from rs1892231, imm_21_44478192, and imm_21_44479552.
37. The genotype of embodiments 5-6, wherein the genotype comprises at least two polymorphisms selected from rs9806914, imm_21_44478192, and imm_21_44479552.
38. The genotype of embodiments 5-6, wherein the genotype comprises at least two polymorphisms selected from rs6478109, rs56124762, and rs1892231.
39. The genotype of embodiments 5-6, wherein the genotype comprises at least two polymorphisms selected from rs6478109, rs56124762, and rs16901748.
40. The genotype of embodiments 5-6, wherein the genotype comprises at least two polymorphisms selected from rs6478109, rs1892231, and rs16901748.

41. The genotype of embodiments 5-6, wherein the genotype comprises at least two polymorphisms selected from rs56124762, rs1892231, and rs16901748.

42. The genotype of embodiments 5-6, wherein the genotype comprises at least two polymorphisms selected from rs6478109, rs2070558, and rs1892231.

43. The genotype of embodiments 5-6, wherein the genotype comprises at least two polymorphisms selected from rs6478109, rs2070558, and rs16901748.

44. The genotype of embodiments 5-6, wherein the genotype comprises at least two polymorphisms selected from rs6478109, rs1892231, and rs16901748.

45. The genotype of embodiments 5-6, wherein the genotype comprises at least two polymorphisms selected from rs2070558, rs1892231, and rs16901748.

46. The genotype of embodiments 5-6, wherein the genotype comprises at least two polymorphisms selected from rs6478109, rs2070561, and rs1892231.

47. The genotype of embodiments 5-6, wherein the genotype comprises at least two polymorphisms selected from rs6478109, rs2070561, and rs16901748.

48. The genotype of embodiments 5-6, wherein the genotype comprises at least two polymorphisms selected from rs6478109, rs1892231, and rs16901748.

49. The genotype of embodiments 5-6, wherein the genotype comprises at least two polymorphisms selected from rs2070561, rs1892231, and rs16901748.

50. The genotype of embodiments 1-49, wherein the genotype comprises a minor allele provided in Table 1 for at least one polymorphism.

51. The genotype of embodiments 1-49, wherein the genotype comprises a major allele provided in Table 1 for at least one polymorphism.

52. The genotype of embodiments 1-51, wherein a presence of the genotype is predictive of a positive therapeutic response to a treatment with an inhibitor of TL1A activity of expression at a positive predictive value of at least about 55%, 60%, 65%, 70%, 75%, 80%, 85%, 90%, 91%, 92%, 93%, 94%, 95%, 96%, 97%, 98%, 99%, or 100%.

53. The genotype of embodiments 1-55, wherein a presence of the genotype is predictive of a positive therapeutic response to a treatment with an inhibitor of TL1A activity of expression with a specificity of at least about 55%, 60%, 65%, 70%, 75%, 80%, 85%, 90%, 91%, 92%, 93%, 94%, 95%, 96%, 97%, 98%, 99%, or 100%.

Aspects disclosed herein provide genotypes that are associated with, and therefore indicative of, a subject having or being susceptible to developing a particular disease or condition, or a subclinical phenotype thereof. In addition, the genotypes disclosed herein are associated with an increase TNFSF15 (TL1A) expression or activity. Thus, the genotypes are indicative that the subject will have a positive therapeutic response to an inhibitor of TL1A activity or expression. Table 1 provides exemplary polymorphisms associated with, and therefore predictive of, a positive therapeutic response to an inhibitor of TNFSF15 (TL1A) expression or activity. The term, "positive therapeutic response" refers to a reduction or an elimination of at least one symptom of the disease or the condition (e.g., Cohn's disease) after induction of a therapy (e.g., anti-TL1A antibody).

TABLE 1

Exemplary Polymorphisms

| rsID | Chip_id | Gene | Minor Allele | Major Allele | SEQ ID NO |
|---|---|---|---|---|---|
| rs11897732 | 1 kg_2_43394890 | THADA | G | A | 1 |
| rs6740739 | 1 kg_2_43709147 | THADA, PLEKHH2 | A | G | 2 |
| rs17796285 | 1 kg_8_11161865 | XKR6, MTMR9 | G | C | 3 |
| rs7935393 | imm_11_127948309 | ETS1 | C | A | 4 |
| rs12934476 | imm_16_11239010 | CLEC16A, SOCS1 | G | A | 5 |
| rs12457255 | imm_18_12749976 | LOC100996324, PTPN2 | A | C | 6 |
| rs2070557 | imm_21_44479552 | ICOSLG | A | T | 7 |
| rs4246905 | imm_9_116593070 | TNFSF15 | A | G | 8 |
| rs10974900 | imm_9_4977958 | JAK2 | A | G | 9 |
| rs12434976 | rs12434976 | LINC01550, C14orf177 | C | A | 10 |
| rs16901748 | rs16901748 | CTNND2 | A | C | 11 |
| rs2815844 | rs2815844 | RGS7 | A | G | 12 |
| rs889702 | rs889702 | RBFOX1 | G | A | 13 |
| rs2409750 | 1 kg_8_11125104 | XKR6, MTMR9 | C | A | 14 |
| rs1541020 | imm_10_6205036 | RBM17, PFKFB3 | A | G | 15 |
| rs4942248 | imm_13_43304805 | ENOX1, CCDC122 | T | A | 16 |
| rs12934476 | imm_16_11239010 | CLEC16A, SOCS1 | G | A | 17 |
| rs12457255 | imm_18_12749976 | LOC100996324, PTPN2 | A | C | 18 |
| rs2297437 | imm_20_61775718 | RTEL1-TNFRSF6B | A | G | 19 |
| rs41309367 | imm_20_61779998 | RTEL1-TNFRSF6B | G | A | 20 |
| rs10733509 | imm_9_4298050 | GLIS3, SLC1A1 | A | G | 21 |
| rs10750376 | rs10750376 | LOC101929497, ETS1 | G | A | 22 |
| rs10932456 | rs10932456 | MIR4776-2, IKZF2 | G | A | 23 |
| rs1326860 | rs1326860 | LINC01031, NONE | A | G | 24 |
| rs1528663 | rs1528663 | FAR1, SPON1 | G | A | 25 |
| rs1892231 | rs1892231 | LINC01550, C14orf177 | C | A | 26 |
| rs951279 | rs951279 | PLXNA2, MIR205HG | G | A | 27 |
| rs9806914 | rs9806914 | RBFOX1 | A | G | 28 |
| rs7935393 | imm_11_127948309 | ETS1 | C | A | 29 |
| rs1690492 | imm_16_11226317 | CLEC16A, SOCS1 | G | C | 30 |
| rs420726 | imm_21_44483873 | ICOSLG | G | A | 31 |
| rs7759385 | imm_6_106695463 | PRDM1, ATG5 | T | A | 32 |
| rs10974900 | imm_9_4977958 | JAK2 | A | G | 33 |
| rs1326860 | rs1326860 | LINC01031, NONE | A | G | 34 |
| rs2548147 | rs2548147 | LINC00603, PTGER4 | C | G | 35 |
| rs2815844 | rs2815844 | RGS7 | A | G | 36 |
| rs889702 | rs889702 | RBFOX1 | G | A | 37 |
| rs9806914 | rs9806914 | RBFOX1 | A | G | 38 |
| rs6478109 | imm_9_116608587 | TNFSF15 | A | G | 39 |
| rs7278257 | imm_21_44478192 | ICOSLG | C | G | 40 |
| rs11221332 | imm_11_127886184 | ETS1 | A | G | 41 |
| rs56124762 | imm_21_44482902 | ICOSLG | A | G | 57 |
| rs2070558 | imm_21_44480086 | ICOSLG | G | A | 58 |
| rs2070561 | rs2070561 | ICOSLG | T | C | 59 |

The instant disclosure provides models comprising 3 polymorphisms (e.g., "3-SNP Models") that, when detected in a sample obtained from a subject, indicate a positive therapeutic response in the subject to a treatment, such as with an inhibitor of TL1A activity or expression. Non-limiting examples of models described herein include Model A (rs6478109, rs7278257, and rs1892231); Model B (rs6478109, rs2070557, and rs9806914); Model C (rs6478109, rs7935393, and rs1892231); Model D (rs6478109, rs7935393, and rs9806914); Model E (rs6478109, rs9806914, and rs16901748); Model F (rs6478109, rs16901748, and rs2297437); Model G (rs6478109, rs1892231, and rs16901748); Model H (rs6478109, rs2070557, and rs7935393); Model I (rs6478109, rs7278257, and rs7935393); Model J (rs6478109, rs9806914, and rs1892231); and Model K (rs6478109, rs7278257, and rs16901748).

METHODS

Methods of Detection

Methods disclosed herein for detecting a genotype in a sample from a subject comprise analyzing the genetic material in the sample to detect at least one of a presence, an absence, and a quantity of a nucleic acid sequence encompassing the genotype of interest. In some embodiments, the sample is assayed to measure a presence, absence or quantity of at least three polymorphisms. In some embodiments, the sample is assayed to measure a presence, absence, or quantity of at least four polymorphisms. In some embodiments, the sample is assayed to measure a presence, absence, or quantity of at least five polymorphisms. In some embodiments, at least three genotypes are detected, using the methods described herein.

In some cases, the nucleic acid sequence comprises DNA. In some instances, the nucleic acid sequence comprises a denatured DNA molecule or fragment thereof. In some instances, the nucleic acid sequence comprises DNA selected from: genomic DNA, viral DNA, mitochondrial DNA, plasmid DNA, amplified DNA, circular DNA, circulating DNA, cell-free DNA, or exosomal DNA. In some instances, the DNA is single-stranded DNA (ssDNA), double-stranded DNA, denaturing double-stranded DNA, synthetic DNA, and combinations thereof. The circular DNA may be cleaved or fragmented. In some instances, the nucleic acid sequence comprises RNA. In some instances, the nucleic acid sequence comprises fragmented RNA. In some instances, the nucleic acid sequence comprises partially degraded RNA. In some instances, the nucleic acid sequence comprises a microRNA or portion thereof. In some instances, the nucleic acid sequence comprises an RNA molecule or a fragmented RNA molecule (RNA fragments) selected from: a microRNA (miRNA), a pre-miRNA, a pri-miRNA, a mRNA, a pre-mRNA, a viral RNA, a viroid RNA, a virusoid RNA, circular RNA (circRNA), a ribosomal RNA (rRNA), a transfer RNA (tRNA), a pre-tRNA, a long non-coding RNA (lncRNA), a small nuclear RNA (snRNA), a circulating RNA, a cell-free RNA, an exosomal RNA, a vector-expressed RNA, an RNA transcript, a synthetic RNA, and combinations thereof.

Nucleic acid-based detection techniques that may be useful for the methods herein include quantitative polymerase chain reaction (qPCR), gel electrophoresis, immunochemistry, in situ hybridization such as fluorescent in situ hybridization (FISH), cytochemistry, and next generation sequencing. In some embodiments, the methods involve real-time (TaqMan™) qPCR, which involves a nucleic acid amplification reaction with a specific primer pair, and hybridization of the amplified nucleic acids with a hydrolysable probe specific to a target nucleic acid.

In some instances, the methods involve hybridization and/or amplification assays that include, but are not limited to, Southern or Northern analyses, polymerase chain reaction analyses, and probe arrays. Non-limiting amplification reactions include, but are not limited to, qPCR, self-sustained sequence replication, transcriptional amplification system, Q-Beta Replicase, rolling circle replication, or any other nucleic acid amplification known in the art. As discussed, reference to qPCR herein includes use of real-time PCR (TaqMan™) methods. An additional exemplary hybridization assay includes the use of nucleic acid probes conjugated or otherwise immobilized on a bead, multi-well plate, or other substrate, wherein the nucleic acid probes are configured to hybridize with a target nucleic acid sequence of a genotype provided herein. A non-limiting method is one employed in Anal Chem. 2013 Feb. 5; 85(3):1932-9.

In some embodiments, detecting the presence or absence of a genotype comprises sequencing genetic material from the subject. Sequencing can be performed with any appropriate sequencing technology, including but not limited to single-molecule real-time (SNRT) sequencing, Polony sequencing, sequencing by ligation, reversible terminator sequencing, proton detection sequencing, ion semiconductor sequencing, nanopore sequencing, electronic sequencing, pyrosequencing, Maxam-Gilbert sequencing, chain termination (e.g., Sanger™) sequencing, +S sequencing, or sequencing-by-synthesis. Sequencing methods also include next-generation sequencing, e.g., modern sequencing technologies such as sequencing-by-synthesis (Illumina®) sequencing (e.g., Solexa™), pyrosequencing (Roche 454™), ion semiconductor (Ion Torrent®) sequencing, and sequencing by oligonucleotide ligation and detection (SOLiD™) sequencing. In some cases, next-generation sequencing involves high-throughput sequencing methods. Additional sequencing methods available to one of skill in the art may also be employed.

In some instances, a number of nucleotides that are sequenced are at least 5, 10, 15, 20, 25, 30, 35, 40, 45, 50, 100, 150, 200, 300, 400, 500, 2000, 4000, 6000, 8000, 10000, 20000, 50000, 100000, or more than 100000 nucleotides. In some instances, the number of nucleotides sequenced is in a range of about 1 to about 100000 nucleotides, about 1 to about 10000 nucleotides, about 1 to about 1000 nucleotides, about 1 to about 500 nucleotides, about 1 to about 300 nucleotides, about 1 to about 200 nucleotides, about 1 to about 100 nucleotides, about 5 to about 100000 nucleotides, about 5 to about 10000 nucleotides, about 5 to about 1000 nucleotides, about 5 to about 500 nucleotides, about 5 to about 300 nucleotides, about 5 to about 200 nucleotides, about 5 to about 100 nucleotides, about 10 to about 100000 nucleotides, about 10 to about 10000 nucleotides, about 10 to about 1000 nucleotides, about 10 to about 500 nucleotides, about 10 to about 300 nucleotides, about 10 to about 200 nucleotides, about 10 to about 100 nucleotides, about 20 to about 100000 nucleotides, about 20 to about 10000 nucleotides, about 20 to about 1000 nucleotides, about 20 to about 500 nucleotides, about 20 to about 300 nucleotides, about 20 to about 200 nucleotides, about 20 to about 100 nucleotides, about 30 to about 100000 nucleotides, about 30 to about 10000 nucleotides, about 30 to about 1000 nucleotides, about 30 to about 500 nucleotides, about 30 to about 300 nucleotides, about 30 to about 200 nucleotides, about 30 to about 100 nucleotides, about 50 to about 100000 nucleotides, about 50 to about 10000 nucleotides, about 50 to about 1000 nucleotides, about 50 to about 500 nucleotides, about 50 to about 300 nucleotides, about 50 to about 200 nucleotides, or about 50 to about 100 nucleotides.

Exemplary probes comprise a nucleic acid sequence of at least 10 contiguous nucleic acids provided in any one of SEQ ID NOS: 1-48, or 57-59, including the nucleobase indicated with a non-nucleobase letter (e.g., R, N, S), or a reverse complement thereof. In some instances, the probes may be used to detect the polymorphisms provided in Table 1, wherein the probe comprises a nucleic acid sequence of at least 10 contiguous nucleic acids provided in a corresponding SEQ ID NO or reverse complement thereof, the 10 contiguous nucleic acids comprising the "risk allele" also provided in Table 1 at a nucleoposition indicated with the non-nucleobase letter, or reverse complement thereof. In some embodiments, the probe comprises at least 70%, 80%, 85%, 90%, 91%, 92%, 93%, 94%, 95%, 96%, 97%, 98% or 99% sequence identity to any one of SEQ ID NOS: 1-48, or 57-59, or its reverse complement. In some instances, forward and reverse primers are used to amplify the target nucleic acid sequence. Forward and reverse primers may comprise a nucleic acid sequence flanking the risk allele provided in Table 1 corresponding to the nucleic acid sequence provided in any one of SEQ ID NOS: 1-48, or 57-59, or a reverse complement thereof.

Examples of molecules that are utilized as probes include, but are not limited to, RNA and DNA. In some embodiments, the term "probe" with regards to nucleic acids, refers to any molecule that is capable of selectively binding to a specifically intended target nucleic acid sequence. In some instances, probes are specifically designed to be labeled, for example, with a radioactive label, a fluorescent label, an enzyme, a chemiluminescent tag, a colorimetric tag, or other labels or tags that are known in the art. In some instances, the fluorescent label comprises a fluorophore. In some instances, the fluorophore is an aromatic or heteroaromatic compound. In some instances, the fluorophore is a pyrene, anthracene, naphthalene, acridine, stilbene, benzoxazole, indole, benzindole, oxazole, thiazole, benzothiazole, canine, carbocyanine, salicylate, anthranilate, xanthenes dye, coumarin. Exemplary xanthene dyes include, e.g., fluorescein and rhodamine dyes. Fluorescein and rhodamine dyes include, but are not limited to 6-carboxyfluorescein (FAM), 2'7'-dimethoxy-4'5'-dichloro-6-carboxyfluorescein (JOE), tetrachlorofluorescein (TET), 6-carboxyrhodamine (R6G), N,N,N; N'-tetramethyl-6-carboxyrhodamine (TAMRA), 6-carboxy-X-rhodamine (ROX). Suitable fluorescent probes also include the naphthylamine dyes that have an amino group in the alpha or beta position. For example, naphthylamino compounds include 1-dimethylaminonaphthyl-5-sulfonate, 1-anilino-8-naphthalene sulfonate and 2-p-toluidinyl-6-naphthalene sulfonate, 5-(2'-aminoethyl) aminonaphthalene-1-sulfonic acid (EDANS). Exemplary coumarins include, e.g., 3-phenyl-7-isocyanatocoumarin; acridines, such as 9-isothiocyanatoacridine and acridine orange; N-(p-(2-b enzoxazolyl)phenyl) maleimide; cyanines, such as, e.g., indodicarbocyanine 3 (Cy3), indodicarbocyanine 5 (Cy5), indodicarbocyanine 5.5 (Cy5.5), 3-(-carboxy-pentyl)-3'-ethyl-5,5'-dimethyloxacarbocyanine (CyA); 1H, 5H, 11H, 15H-Xantheno[2,3, 4-ij: 5,6, 7-i'j'] diquinolizin-18-ium, 9-[2 (or 4)-[[[6-[2,5-dioxo-1-pyrrolidinyl]oxy]-6-oxohexyl]amino]sulfonyl]-4 (or 2)-sulfophenyl]-2,3, 6,7, 12,13, 16,17-octahydro-inner salt (TR or Texas Red); or BODIPY™ dyes. In some cases, the probe comprises FAM as the dye label.

In some instances, primers and/or probes described herein for detecting a target nucleic acid are used in an amplification reaction. In some instances, the amplification reaction is qPCR. An exemplary qPCR is a method employing a TaqMan™ assay. Non-limiting examples of primer pairs useful for detecting one or more polymorphisms described herein are provided in Table 6, below.

TABLE 6

Exemplary Primer Sequences

| rsID | Forward Primer | Reverse Primer | Wt_Probe_Hex | Mut_Probe_FAM |
| --- | --- | --- | --- | --- |
| rs6478109 | TGCTTCTGGAAG TGAAAGT (SEQ ID NO: 364101) | TGAGGTTCAAAAT GACAGAGG (SEQ ID NO: 364111) | TG+C +AG+A +T+TG GGA (SEQ ID NO: 364121) | TG+C +AGG +TGG GGA (SEQ ID NO: 364131) |
| rs1892231 | GTCATCATCGCT TTCATGTG (SEQ ID NO: 364102) | TTT TCA ATG CAC AGA TTT AAG GA (SEQ ID NO: 364112) | AT +T+TG +G+A+A AGGG+AA (SEQ ID NO: 364122) | ATT TGG +C+A+A GGG AA (SEQ ID NO: 364132) |
| rs7935393 | CTGGATGCTCAC AGGTTTG (SEQ ID NO: 364103) | CCT AAG GAG ACT TTT AGT TCT AAG (SEQ ID NO: 364113) | AG+A A+T+A +CA+C A+AG GA (SEQ ID NO: 364123) | T+AG+AA+T +C+C+A CAA (SEQ ID NO: 364133) |
| rs7278257 | AGTCCCTGTTCT GAATCCTCT (SEQ ID NO: 364104) | ATGGGGAACGTT GTGGCAG (SEQ ID NO: 364114) | TC+C +TA+G +C+G+A TA (SEQ ID NO: 364124) | T+C+C TA+G +G+GA TA (SEQ ID NO: 364134) |
| rs2070557 | CTT TTT GTC TCC TAC CTC AGA GG (SEQ ID NO: 364105) | CGG CAG CCA GAC AGG TAA (SEQ ID NO: 364115) | CGG GC+A +C+AG C+TC (SEQ ID NO: 364125) | TCG GGC +TC+A GC+T C (SEQ ID NO: 364135) |
| rs9806914 | ATAAGAACCTCT GCTGCACA (SEQ ID NO: 364106) | ACAGAGGCAGTA TAGCACAG (SEQ ID NO: 364116) | A+GT +GAT T+G+A +CT+C AA (SEQ ID NO: 364126) | AGT GAT T+G+G +CTC AA (SEQ ID NO: 364136) |

TABLE 6-continued

Exemplary Primer Sequences

| rsID | Forward Primer | Reverse Primer | Wt_Probe_Hex | Mut_Probe_FAM |
|---|---|---|---|---|
| rs16901748 | TTGGGAATCAGA TAGGTGCA (SEQ ID NO: 364107) | ATC AAG TCA CAA CTG CCA GA (SEQ ID NO: 364117) | C+CA TTA A+A+G +T+CA +GA (SEQ ID NO: 364127) | A+C+C ATT AA+A +T+T+C AGA (SEQ ID NO: 364137) |
| rs56124762 | AAA CAG GAA CAG GCT GGT TC (SEQ ID NO: 364108) | GCTCTGCCTTCAC ATTTCTG (SEQ ID NO: 364118) | TAG +T+T+A +A+G+C CCAT (SEQ ID NO: 364128) | TAG T+T+A +G+GC CCA (SEQ ID NO: 364138) |
| rs2070558 | CCAAGCCAGTCC CAGTAG (SEQ ID NO: 364109) | AAT GAC CAG ATC CAA ATG AGG (SEQ ID NO: 364119) | AGG GAC +C+G+C TGA (SEQ ID NO: 364129) | AGG GAC +C+A+C +TGA (SEQ ID NO: 364139) |
| rs2070561 | TTG GCA AGG TTT CAG GTT TG (SEQ ID NO: 364110) | GTC CCC TGG TCT CCC TGT C (SEQ ID NO: 364120) | CGG T+G+C +T+TC GTC C (SEQ ID NO: 364130) | CGG TGC +C+TC GTC C (SEQ ID NO: 364140) |

"Wt_Probe_Hex" and "Mut_Probe_FAM" mean "Wild type_probes_tagged with HEX reporter dye" and"Mut_probe_tagged with FAM reporter dye", respectively. "+" stands for LNA bases (Locked nucleotides), which are analogues that are modified at 2'-O, 4'-C and form a bridge. This bridge results in restricted base pairing giving room to adjust the Tm as needed between the probes. Thus, +A, +T, +C or +G signify A, T, G or C bases are added on the modified backbone.

In some instances, qPCR comprises using an intercalating dye. Examples of intercalating dyes include SYBR green I, SYBR green II, SYBR gold, ethidium bromide, methylene blue, Pyronin Y, DAPI, acridine orange, Blue View or phycoerythrin. In some instances, the intercalating dye is SYBR.

In some instances, a number of amplification cycles for detecting a target nucleic acid in an amplification assay is about 5 to about 30 cycles. In some instances, the number of amplification cycles for detecting a target nucleic acid is at least about 5 cycles. In some instances, the number of amplification cycles for detecting a target nucleic acid is at most about 30 cycles. In some instances, the number of amplification cycles for detecting a target nucleic acid is about 5 to about 10, about 5 to about 15, about 5 to about 20, about 5 to about 25, about 5 to about 30, about 10 to about 15, about 10 to about 20, about 10 to about 25, about 10 to about 30, about 15 to about 20, about 15 to about 25, about 15 to about 30, about 20 to about 25, about 20 to about 30, or about 25 to about 30 cycles.

In one aspect, the methods provided herein for determining the presence, absence, and/or quantity of a nucleic acid sequence from a particular genotype comprise an amplification reaction such as qPCR. In an exemplary method, genetic material is obtained from a sample of a subject, e.g., a sample of blood or serum. In certain embodiments where nucleic acids are extracted, the nucleic acids are extracted using any technique that does not interfere with subsequent analysis. In certain embodiments, this technique uses alcohol precipitation using ethanol, methanol, or isopropyl alcohol. In certain embodiments, this technique uses phenol, chloroform, or any combination thereof. In certain embodiments, this technique uses cesium chloride. In certain embodiments, this technique uses sodium, potassium or ammonium acetate or any other salt commonly used to precipitate DNA. In certain embodiments, this technique utilizes a column or resin based nucleic acid purification scheme such as those commonly sold commercially, one non-limiting example would be the GenElute Bacterial Genomic DNA Kit available from Sigma Aldrich. In certain embodiments, after extraction the nucleic acid is stored in water, Tris buffer, or Tris-EDTA buffer before subsequent analysis. In an exemplary embodiment, the nucleic acid material is extracted in water. In some cases, extraction does not comprise nucleic acid purification.

In the exemplary qPCR assay, the nucleic acid sample is combined with primers and probes specific for a target nucleic acid that may or may not be present in the sample, and a DNA polymerase. An amplification reaction is performed with a thermal cycler that heats and cools the sample for nucleic acid amplification, and illuminates the sample at a specific wavelength to excite a fluorophore on the probe and detect the emitted fluorescence. For TaqMan™ methods, the probe may be a hydrolysable probe comprising a fluorophore and quencher that is hydrolyzed by DNA polymerase when hybridized to a target nucleic acid. In some cases, the presence of a target nucleic acid is determined when the number of amplification cycles to reach a threshold value is less than 30, 29, 28, 27, 26, 25, 24, 23, 22, 21, or 20 cycles.

In some embodiments, the target nucleic acid is at least 10 contiguous nucleic acid molecules of SEQ ID NO: 1 comprising a non-reference allele at nucleoposition 501 within SEQ ID NO: 1. In some embodiments, the target nucleic acid is at least 10 contiguous nucleic acid molecules of SEQ ID NO: 1 comprising a "G" or an "A" allele at nucleoposition 501 within SEQ ID NO: 1. In some embodiments, detecting the at least 10 contiguous nucleic acid molecules comprising a "G" or an "A" allele at nucleoposition 501 within SEQ ID NO: 1 is sufficient to detect the polymorphism at rs11897732.

In some embodiments, the target nucleic acid is at least 10 contiguous nucleic acid molecules of SEQ ID NO: 2 comprising non-reference allele at nucleoposition 501 within SEQ ID NO: 2. In some embodiments, the target nucleic acid is at least 10 contiguous nucleic acid molecules of SEQ ID NO: 2 comprising an "A" or a "G" allele at nucleoposition 501 within SEQ ID NO: 2. In some embodiments, detecting the at least 10 contiguous nucleic acid molecules comprising an "A" or a "G" allele at nucleoposition 501 within SEQ ID NO: 2 is sufficient to detect the polymorphism at rs6740739.

In some embodiments, the target nucleic acid is at least 10 contiguous nucleic acid molecules of SEQ ID NO: 3 comprising a non-reference allele at nucleoposition 501 within SEQ ID NO: 3. In some embodiments, the target nucleic acid is at least 10 contiguous nucleic acid molecules of SEQ ID NO: 3 comprising a "G" or a "C" allele at nucleoposition 501 within SEQ ID NO: 3. In some embodiments, detecting the at least 10 contiguous nucleic acid molecules comprising a "G" or a "C" allele at nucleoposition 501 within SEQ ID NO: 3 is sufficient to detect the polymorphism at rs17796285.

In some embodiments, the target nucleic acid is at least 10 contiguous nucleic acid molecules of SEQ ID NO: 4 comprising a non-reference allele at nucleoposition 501 within SEQ ID NO: 4. In some embodiments, the target nucleic acid is at least 10 contiguous nucleic acid molecules of SEQ ID NO: 4 comprising a "C" or an "A" allele at nucleoposition 501 within SEQ ID NO: 4. In some embodiments, detecting the at least 10 contiguous nucleic acid molecules comprising a "C" or an "A" allele at nucleoposition 501 within SEQ ID NO: 4 is sufficient to detect the polymorphism at rs7935393.

In some embodiments, the target nucleic acid is at least 10 contiguous nucleic acid molecules of SEQ ID NO: 5 comprising a non-reference allele at nucleoposition 501 within SEQ ID NO: 5. In some embodiments, the target nucleic acid is at least 10 contiguous nucleic acid molecules of SEQ ID NO: 5 comprising a "G" or an "A" allele at nucleoposition 501 within SEQ ID NO: 5. In some embodiments, detecting the at least 10 contiguous nucleic acid molecules comprising a "G" of an "A" allele at nucleoposition 501 within SEQ ID NO: 5 is sufficient to detect the polymorphism at rs12934476.

In some embodiments, the target nucleic acid is at least 10 contiguous nucleic acid molecules of SEQ ID NO: 6 comprising a non-reference allele at nucleoposition 501 within SEQ ID NO: 6. In some embodiments, the target nucleic acid is at least 10 contiguous nucleic acid molecules of SEQ ID NO: 6 comprising an "A" or a "C" allele at nucleoposition 501 within SEQ ID NO: 6. In some embodiments, detecting the at least 10 contiguous nucleic acid molecules comprising an "A" or a "C" allele at nucleoposition 501 within SEQ ID NO: 6 is sufficient to detect the polymorphism at rs12457255.

In some embodiments, the target nucleic acid is at least 10 contiguous nucleic acid molecules of SEQ ID NO: 7 comprising a non-reference allele at nucleoposition 501 within SEQ ID NO: 7. In some embodiments, the target nucleic acid is at least 10 contiguous nucleic acid molecules of SEQ ID NO: 7 comprising an "A" or a "T" allele at nucleoposition 501 within SEQ ID NO: 7. In some embodiments, detecting the at least 10 contiguous nucleic acid molecules comprising an "A" or a "T" allele at nucleoposition 501 within SEQ ID NO: 7 is sufficient to detect the polymorphism at rs2070557.

In some embodiments, the target nucleic acid is at least 10 contiguous nucleic acid molecules of SEQ ID NO: 8 comprising a non-reference allele at nucleoposition 501 within SEQ ID NO: 8. In some embodiments, the target nucleic acid is at least 10 contiguous nucleic acid molecules of SEQ ID NO: 8 comprising an "A" or a "G" allele at nucleoposition 501 within SEQ ID NO: 8. In some embodiments, detecting the at least 10 contiguous nucleic acid molecules comprising an "A" or "G" allele at nucleoposition 501 within SEQ ID NO: 8 is sufficient to detect the polymorphism at rs4246905.

In some embodiments, the target nucleic acid is at least 10 contiguous nucleic acid molecules of SEQ ID NO: 9 comprising a non-reference allele at nucleoposition 501 within SEQ ID NO: 9. In some embodiments, the target nucleic acid is at least 10 contiguous nucleic acid molecules of SEQ ID NO: 9 comprising an "A" or a "G" allele at nucleoposition 501 within SEQ ID NO: 9. In some embodiments, detecting the at least 10 contiguous nucleic acid molecules comprising an "A" or a "G" allele at nucleoposition 501 within SEQ ID NO: 9 is sufficient to detect the polymorphism at rs10974900.

In some embodiments, the target nucleic acid is at least 10 contiguous nucleic acid molecules of SEQ ID NO: 10 comprising a non-reference allele at nucleoposition 501 within SEQ ID NO: 10. In some embodiments, the target nucleic acid is at least 10 contiguous nucleic acid molecules of SEQ ID NO: 10 comprising a "C" or an "A" allele at nucleoposition 501 within SEQ ID NO: 10. In some embodiments, detecting the at least 10 contiguous nucleic acid molecules comprising a "C" or an "A" allele at nucleoposition 501 within SEQ ID NO: 10 is sufficient to detect the polymorphism at rs12434976.

In some embodiments, the target nucleic acid is at least 10 contiguous nucleic acid molecules of SEQ ID NO: 11 comprising a non-reference allele at nucleoposition 501 within SEQ ID NO: 11. In some embodiments, the target nucleic acid is at least 10 contiguous nucleic acid molecules of SEQ ID NO: 11 comprising an "A" or a "C" allele at nucleoposition 501 within SEQ ID NO: 11. In some embodiments, detecting the at least 10 contiguous nucleic acid molecules comprising an "A" or a "C" allele at nucleoposition 501 within SEQ ID NO: 11 is sufficient to detect the polymorphism at rs16901748.

In some embodiments, the target nucleic acid is at least 10 contiguous nucleic acid molecules of SEQ ID NO: 12 comprising a non-reference allele at nucleoposition 501 within SEQ ID NO: 12. In some embodiments, the target nucleic acid is at least 10 contiguous nucleic acid molecules of SEQ ID NO: 12 comprising an "A" or a "G" allele at nucleoposition 501 within SEQ ID NO: 12. In some embodiments, detecting the at least 10 contiguous nucleic acid molecules comprising an "A" or a "G" allele at nucleoposition 501 within SEQ ID NO: 12 is sufficient to detect the polymorphism at rs2815844.

In some embodiments, the target nucleic acid is at least 10 contiguous nucleic acid molecules of SEQ ID NO: 13 comprising a non-reference allele at nucleoposition 501 within SEQ ID NO: 13. In some embodiments, the target nucleic acid is at least 10 contiguous nucleic acid molecules of SEQ ID NO: 13 comprising a "G" or an "A" allele at nucleoposition 501 within SEQ ID NO: 13. In some embodiments, detecting the at least 10 contiguous nucleic acid molecules comprising a "G" or an "A" allele at nucleoposition 501 within SEQ ID NO: 13 is sufficient to detect the polymorphism at rs889702.

In some embodiments, the target nucleic acid is at least 10 contiguous nucleic acid molecules of SEQ ID NO: 14 comprising a non-reference allele at nucleoposition 501 within SEQ ID NO: 14. In some embodiments, the target nucleic acid is at least 10 contiguous nucleic acid molecules of SEQ ID NO: 14 comprising a "C" or an "A" allele at nucleoposition 501 within SEQ ID NO: 14. In some embodiments, detecting the at least 10 contiguous nucleic acid molecules comprising a "C" or an "A" allele at nucleoposition 501 within SEQ ID NO: 14 is sufficient to detect the polymorphism at rs2409750.

In some embodiments, the target nucleic acid is at least 10 contiguous nucleic acid molecules of SEQ ID NO: 15 comprising a non-reference allele at nucleoposition 501 within SEQ ID NO: 15. In some embodiments, the target nucleic acid is at least 10 contiguous nucleic acid molecules of SEQ ID NO: 15 comprising an "A" or a "G" allele at nucleoposition 501 within SEQ ID NO: 15. In some embodiments, detecting the at least 10 contiguous nucleic acid molecules comprising an "A" or "G" allele at nucleoposition 501 within SEQ ID NO: 15 is sufficient to detect the polymorphism at rs1541020.

In some embodiments, the target nucleic acid is at least 10 contiguous nucleic acid molecules of SEQ ID NO: 16 comprising a non-reference allele at nucleoposition 501 within SEQ ID NO: 16. In some embodiments, the target nucleic acid is at least 10 contiguous nucleic acid molecules of SEQ ID NO: 16 comprising a "T" or an "A" allele at nucleoposition 501 within SEQ ID NO: 16. In some embodiments, detecting the at least 10 contiguous nucleic acid molecules comprising a "T" or an "A" allele at nucleoposition 501 within SEQ ID NO: 16 is sufficient to detect the polymorphism at rs4942248.

In some embodiments, the target nucleic acid is at least 10 contiguous nucleic acid molecules of SEQ ID NO: 17 comprising a non-reference allele at nucleoposition 501 within SEQ ID NO: 17. In some embodiments, the target nucleic acid is at least 10 contiguous nucleic acid molecules of SEQ ID NO: 17 comprising a "G" or an "A" allele at nucleoposition 501 within SEQ ID NO: 17. In some embodiments, detecting the at least 10 contiguous nucleic acid molecules comprising a "G" or an "A" allele at nucleoposition 501 within SEQ ID NO: 17 is sufficient to detect the polymorphism at rs12934476.

In some embodiments, the target nucleic acid is at least 10 contiguous nucleic acid molecules of SEQ ID NO: 18 comprising a non-reference allele at nucleoposition 501 within SEQ ID NO: 18. In some embodiments, the target nucleic acid is at least 10 contiguous nucleic acid molecules of SEQ ID NO: 18 comprising an "A" or a "C" allele at nucleoposition 501 within SEQ ID NO: 18. In some embodiments, detecting the at least 10 contiguous nucleic acid molecules comprising an "A" or a "C" allele at nucleoposition 501 within SEQ ID NO: 18 is sufficient to detect the polymorphism at rs12457255.

In some embodiments, the target nucleic acid is at least 10 contiguous nucleic acid molecules of SEQ ID NO: 19 comprising a non-reference allele at nucleoposition 501 within SEQ ID NO: 19. In some embodiments, the target nucleic acid is at least 10 contiguous nucleic acid molecules of SEQ ID NO: 19 comprising an "A" or a "G" allele at nucleoposition 501 within SEQ ID NO: 19. In some embodiments, detecting the at least 10 contiguous nucleic acid molecules comprising an "A" or a "G" allele at nucleoposition 501 within SEQ ID NO: 19 is sufficient to detect the polymorphism at rs2297437.

In some embodiments, the target nucleic acid is at least 10 contiguous nucleic acid molecules of SEQ ID NO: 20 comprising a non-reference allele at nucleoposition 501 within SEQ ID NO: 20. In some embodiments, the target nucleic acid is at least 10 contiguous nucleic acid molecules of SEQ ID NO: 20 comprising a "G" or an "A" allele at nucleoposition 501 within SEQ ID NO: 20. In some embodiments, detecting the at least 10 contiguous nucleic acid molecules comprising a "G" or an "A" allele at nucleoposition 501 within SEQ ID NO: 20 is sufficient to detect the polymorphism at rs41309367.

In some embodiments, the target nucleic acid is at least 10 contiguous nucleic acid molecules of SEQ ID NO: 21 comprising a non-reference allele at nucleoposition 501 within SEQ ID NO: 21. In some embodiments, the target nucleic acid is at least 10 contiguous nucleic acid molecules of SEQ ID NO: 21 comprising an "A" or a "G" allele at nucleoposition 501 within SEQ ID NO: 21. In some embodiments, detecting the at least 10 contiguous nucleic acid molecules comprising an "A" or a "G" allele at nucleoposition 501 within SEQ ID NO: 21 is sufficient to detect the polymorphism at rs10733509.

In some embodiments, the target nucleic acid is at least 10 contiguous nucleic acid molecules of SEQ ID NO: 22 comprising a non-reference allele at nucleoposition 501 within SEQ ID NO: 22. In some embodiments, the target nucleic acid is at least 10 contiguous nucleic acid molecules of SEQ ID NO: 22 comprising a "G" or an "A" allele at nucleoposition 501 within SEQ ID NO: 22. In some embodiments, detecting the at least 10 contiguous nucleic acid molecules comprising a "G" or an "A" allele at nucleoposition 501 within SEQ ID NO: 22 is sufficient to detect the polymorphism at rs10750376.

In some embodiments, the target nucleic acid is at least 10 contiguous nucleic acid molecules of SEQ ID NO: 23 comprising a non-reference allele at nucleoposition 501 within SEQ ID NO: 23. In some embodiments, the target nucleic acid is at least 10 contiguous nucleic acid molecules of SEQ ID NO: 23 comprising a "G" or an "A" allele at nucleoposition 501 within SEQ ID NO: 23. In some embodiments, detecting the at least 10 contiguous nucleic acid molecules comprising a "G" or an "A" allele at nucleoposition 501 within SEQ ID NO: 23 is sufficient to detect the polymorphism at rs10932456.

In some embodiments, the target nucleic acid is at least 10 contiguous nucleic acid molecules of SEQ ID NO: 24 comprising a non-reference allele at nucleoposition 501 within SEQ ID NO: 24. In some embodiments, the target nucleic acid is at least 10 contiguous nucleic acid molecules of SEQ ID NO: 24 comprising an "A" or a "G" allele at nucleoposition 501 within SEQ ID NO: 24. In some embodiments, detecting the at least 10 contiguous nucleic acid molecules comprising an "A" or a "G" allele at nucleoposition 501 within SEQ ID NO: 24 is sufficient to detect the polymorphism at rs1326860.

In some embodiments, the target nucleic acid is at least 10 contiguous nucleic acid molecules of SEQ ID NO: 25 comprising a "G" or an "A" allele at nucleoposition 501 within SEQ ID NO: 25. In some embodiments, detecting the at least 10 contiguous nucleic acid molecules comprising a "G" or an "A" allele at nucleoposition 501 within SEQ ID NO: 25 is sufficient to detect the polymorphism at rs1528663.

In some embodiments, the target nucleic acid is at least 10 contiguous nucleic acid molecules of SEQ ID NO: 26 comprising a non-reference allele at nucleoposition 501 within SEQ ID NO: 26. In some embodiments, the target nucleic acid is at least 10 contiguous nucleic acid molecules of SEQ ID NO: 26 comprising a "C" or an "A" allele at nucleoposition 501 within SEQ ID NO: 26. In some embodiments, detecting the at least 10 contiguous nucleic acid molecules comprising a "C" or an "A" allele at nucleoposition 501 within SEQ ID NO: 26 is sufficient to detect the polymorphism at rs1892231.

In some embodiments, the target nucleic acid is at least 10 contiguous nucleic acid molecules of SEQ ID NO: 27 comprising a non-reference allele at nucleoposition 501 within SEQ ID NO: 27. In some embodiments, the target nucleic acid is at least 10 contiguous nucleic acid molecules of SEQ ID NO: 27 comprising a "G" or an "A" allele at nucleoposition 501 within SEQ ID NO: 27. In some embodiments, detecting the at least 10 contiguous nucleic acid molecules comprising a "G" or an "A" allele at nucleoposition 501 within SEQ ID NO: 27 is sufficient to detect the polymorphism at rs951279.

In some embodiments, the target nucleic acid is at least 10 contiguous nucleic acid molecules of SEQ ID NO: 28 comprising a non-reference allele at nucleoposition 501 within SEQ ID NO: 28. In some embodiments, the target nucleic acid is at least 10 contiguous nucleic acid molecules of SEQ ID NO: 28 comprising an "A" or a "G" allele at nucleoposition 501 within SEQ ID NO: 28. In some embodiments, detecting the at least 10 contiguous nucleic acid molecules comprising an "A" or a "G" allele at nucleoposition 501 within SEQ ID NO: 28 is sufficient to detect the polymorphism at rs9806914.

In some embodiments, the target nucleic acid is at least 10 contiguous nucleic acid molecules of SEQ ID NO: 29 comprising a non-reference allele at nucleoposition 501 within SEQ ID NO: 29. In some embodiments, the target nucleic acid is at least 10 contiguous nucleic acid molecules of SEQ ID NO: 29 comprising a "C" or an "A" allele at nucleoposition 501 within SEQ ID NO: 29. In some embodiments, detecting the at least 10 contiguous nucleic acid molecules comprising a "C" or an "A" allele at nucleoposition 501 within SEQ ID NO: 29 is sufficient to detect the polymorphism at rs7935393.

In some embodiments, the target nucleic acid is at least 10 contiguous nucleic acid molecules of SEQ ID NO: 30 comprising a non-reference allele at nucleoposition 501 within SEQ ID NO: 30. In some embodiments, the target nucleic acid is at least 10 contiguous nucleic acid molecules of SEQ ID NO: 30 comprising a "G" or a "C" allele at nucleoposition 501 within SEQ ID NO: 30. In some embodiments, detecting the at least 10 contiguous nucleic acid molecules comprising a "G" or a "C" allele at nucleoposition 501 within SEQ ID NO: 30 is sufficient to detect the polymorphism at rs1690492.

In some embodiments, the target nucleic acid is at least 10 contiguous nucleic acid molecules of SEQ ID NO: 31 comprising a non-reference allele at nucleoposition 501 within SEQ ID NO: 31. In some embodiments, the target nucleic acid is at least 10 contiguous nucleic acid molecules of SEQ ID NO: 31 comprising a "G" or an "A" allele at nucleoposition 501 within SEQ ID NO: 31. In some embodiments, detecting the at least 10 contiguous nucleic acid molecules comprising a "G" or an "A" allele at nucleoposition 501 within SEQ ID NO: 31 is sufficient to detect the polymorphism at rs420726.

In some embodiments, the target nucleic acid is at least 10 contiguous nucleic acid molecules of SEQ ID NO: 32 comprising a non-reference allele at nucleoposition 501 within SEQ ID NO: 32. In some embodiments, the target nucleic acid is at least 10 contiguous nucleic acid molecules of SEQ ID NO: 32 comprising a "T" or an "A" allele at nucleoposition 501 within SEQ ID NO: 32. In some embodiments, detecting the at least 10 contiguous nucleic acid molecules comprising a "T" of an "A" allele at nucleoposition 501 within SEQ ID NO: 32 is sufficient to detect the polymorphism at rs7759385.

In some embodiments, the target nucleic acid is at least 10 contiguous nucleic acid molecules of SEQ ID NO: 33 comprising a non-reference allele at nucleoposition 501 within SEQ ID NO: 33. In some embodiments, the target nucleic acid is at least 10 contiguous nucleic acid molecules of SEQ ID NO: 33 comprising an "A" or a "G" allele at nucleoposition 501 within SEQ ID NO: 33. In some embodiments, detecting the at least 10 contiguous nucleic acid molecules comprising an "A" or a "G" allele at nucleoposition 501 within SEQ ID NO: 33 is sufficient to detect the polymorphism at rs10974900.

In some embodiments, the target nucleic acid is at least 10 contiguous nucleic acid molecules of SEQ ID NO: 34 comprising a non-reference allele at nucleoposition 501 within SEQ ID NO: 34. In some embodiments, the target nucleic acid is at least 10 contiguous nucleic acid molecules of SEQ ID NO: 34 comprising an "A" or a "G" allele at nucleoposition 501 within SEQ ID NO: 34. In some embodiments, detecting the at least 10 contiguous nucleic acid molecules comprising an "A" or a "G" allele at nucleoposition 501 within SEQ ID NO: 34 is sufficient to detect the polymorphism at rs1326860.

In some embodiments, the target nucleic acid is at least 10 contiguous nucleic acid molecules of SEQ ID NO: 35 comprising a non-reference allele at nucleoposition 501 within SEQ ID NO: 35. In some embodiments, the target nucleic acid is at least 10 contiguous nucleic acid molecules of SEQ ID NO: 35 comprising a "C" or a "G" allele at nucleoposition 501 within SEQ ID NO: 35. In some embodiments, detecting the at least 10 contiguous nucleic acid molecules comprising a "C" or a "G" allele at nucleoposition 501 within SEQ ID NO: 35 is sufficient to detect the polymorphism at rs2548147.

In some embodiments, the target nucleic acid is at least 10 contiguous nucleic acid molecules of SEQ ID NO: 36 comprising a non-reference allele at nucleoposition 501 within SEQ ID NO: 36. In some embodiments, the target nucleic acid is at least 10 contiguous nucleic acid molecules of SEQ ID NO: 36 comprising an "A" or a "G" allele at nucleoposition 501 within SEQ ID NO: 36. In some embodiments, detecting the at least 10 contiguous nucleic acid molecules comprising an "A" of a "G" allele at nucleoposition 501 within SEQ ID NO: 36 is sufficient to detect the polymorphism at rs2815844.

In some embodiments, the target nucleic acid is at least 10 contiguous nucleic acid molecules of SEQ ID NO: 37 comprising a non-reference allele at nucleoposition 501 within SEQ ID NO: 37. In some embodiments, the target nucleic acid is at least 10 contiguous nucleic acid molecules of SEQ ID NO: 37 comprising a "G" or an "A" allele at nucleoposition 501 within SEQ ID NO: 37. In some embodiments, detecting the at least 10 contiguous nucleic acid molecules comprising a "G" or an "A" allele at nucleoposition 501 within SEQ ID NO: 37 is sufficient to detect the polymorphism at rs889702.

In some embodiments, the target nucleic acid is at least 10 contiguous nucleic acid molecules of SEQ ID NO: 38 comprising a non-reference allele at nucleoposition 501 within SEQ ID NO: 38. In some embodiments, the target nucleic acid is at least 10 contiguous nucleic acid molecules of SEQ ID NO: 38 comprising an "A" or a "G" allele at nucleoposition 501 within SEQ ID NO: 38. In some embodiments, detecting the at least 10 contiguous nucleic acid molecules comprising an "A" or a "G" allele at nucleoposition 501 within SEQ ID NO: 38 is sufficient to detect the polymorphism at rs9806914.

In some embodiments, the target nucleic acid is at least 10 contiguous nucleic acid molecules of SEQ ID NO: 39 comprising a non-reference allele at nucleoposition 501 within SEQ ID NO: 39. In some embodiments, the target nucleic acid is at least 10 contiguous nucleic acid molecules of SEQ ID NO: 39 comprising an "A" or a "G" allele at nucleoposition 501 within SEQ ID NO: 39. In some embodiments, detecting the at least 10 contiguous nucleic acid molecules comprising an "A" or a "G" allele at nucleoposition 501 within SEQ ID NO: 39 is sufficient to detect the polymorphism at rs6478109.

In some embodiments, the target nucleic acid is at least 10 contiguous nucleic acid molecules of SEQ ID NO: 40 comprising a non-reference allele at nucleoposition 501 within SEQ ID NO: 40. In some embodiments, the target nucleic acid is at least 10 contiguous nucleic acid molecules of SEQ ID NO: 40 comprising a "C" or a "G" allele at nucleoposition 501 within SEQ ID NO: 40. In some embodiments, detecting the at least 10 contiguous nucleic acid molecules comprising a "C" or a "G" allele at nucleoposition 501 within SEQ ID NO: 40 is sufficient to detect the polymorphism at rs7278257.

In some embodiments, the target nucleic acid is at least 10 contiguous nucleic acid molecules of SEQ ID NO: 41 comprising a non-reference allele at nucleoposition 501 within SEQ ID NO: 41. In some embodiments, the target nucleic acid is at least 10 contiguous nucleic acid molecules of SEQ ID NO: 41 comprising an "A" or a "G" allele at nucleoposition 501 within SEQ ID NO: 41. In some embodiments, detecting the at least 10 contiguous nucleic acid molecules comprising an "A" or a "G" allele at nucleoposition 501 within SEQ ID NO: 41 is sufficient to detect the polymorphism at rs11221332.

In some embodiments, the target nucleic acid is at least 10 contiguous nucleic acid molecules of SEQ ID NO: 57 comprising a non-reference allele at nucleoposition 501 within SEQ ID NO: 57. In some embodiments, the target nucleic acid is at least 10 contiguous nucleic acid molecules of SEQ ID NO: 57 comprising an "A" or a "G" allele at nucleoposition 501 within SEQ ID NO: 57. In some embodiments, detecting the at least 10 contiguous nucleic acid molecules comprising an "A" or a "G" allele at nucleoposition 501 within SEQ ID NO: 57 is sufficient to detect the polymorphism at rs56124762.

In some embodiments, the target nucleic acid is at least 10 contiguous nucleic acid molecules of SEQ ID NO: 58 comprising a non-reference allele at nucleoposition 501 within SEQ ID NO: 58. In some embodiments, the target nucleic acid is at least 10 contiguous nucleic acid molecules of SEQ ID NO: 58 comprising an "A" or a "G" allele at nucleoposition 501 within SEQ ID NO: 58. In some embodiments, detecting the at least 10 contiguous nucleic acid molecules comprising an "A" or a "G" allele at nucleoposition 501 within SEQ ID NO: 58 is sufficient to detect the polymorphism at rs2070558.

In some embodiments, the target nucleic acid is at least 10 contiguous nucleic acid molecules of SEQ ID NO: 59 comprising a non-reference allele at nucleoposition 501 within SEQ ID NO: 59. In some embodiments, the target nucleic acid is at least 10 contiguous nucleic acid molecules of SEQ ID NO: 59 comprising an "T" or a "C" allele at nucleoposition 501 within SEQ ID NO: 59. In some embodiments, detecting the at least 10 contiguous nucleic acid molecules comprising an "T" or a "C" allele at nucleoposition 501 within SEQ ID NO: 59 is sufficient to detect the polymorphism at rs2070561.

In some embodiments, one target nucleic acid (e.g., a polymorphism) is detected with the methods disclosed herein. In some embodiments, at least 2, 3, 4, 5, 6, 7, 8, 9, or 10 target nucleic acids are detected. In some embodiments, the at least 2, 3, 4, 5, 6, 7, 8, 9, or 10 target nucleic acids are detected in a single multiplexed assay. In some embodiments, when 4 target nucleic acids are detected in a sample from subject, 4 unique 3-polymorphism combinations are measured. In a non-limiting example, a sample (e.g., blood or plasma) obtained from a subject is contacted by 4 primer pairs, each primer pair individually adapted to amplify rs6487109, rs56124762, rs1892231, and rs16901748, respectively. A positive, negative, or indeterminate TNFSF15 profile may depend, at least in part, on which of the 3-polymorphism combinations is detected in the sample, and/or whether the genotype is heterozygous or homozygous for the polymorphism. In this example, assaying 4 polymorphism means a total of 4 unique 3-polymorphisms may be detected in the patient sample, which are rs6478109, rs56124762, rs1892231; rs6478109, rs56124762, rs16901748; r s6478109, rs1892231, rs16901748; and rs56124762, rs1892231, rs16901748. Each polymorphism detected may be heterozygous or homozygous.

To practice the methods and systems provided herein, genetic material may be extracted from a sample obtained from a subject, e.g., a sample of blood or serum. In certain embodiments where nucleic acids are extracted, the nucleic acids are extracted using any technique that does not interfere with subsequent analysis. In certain embodiments, this technique uses alcohol precipitation using ethanol, methanol or isopropyl alcohol. In certain embodiments, this technique uses phenol, chloroform, or any combination thereof. In certain embodiments, this technique uses cesium chloride. In certain embodiments, this technique uses sodium, potassium or ammonium acetate or any other salt commonly used to precipitate DNA. In certain embodiments, this technique utilizes a column or resin based nucleic acid purification scheme such as those commonly sold commercially, one non-limiting example would be the GenElute Bacterial Genomic DNA Kit available from Sigma Aldrich. In certain embodiments, after extraction the nucleic acid is stored in water, Tris buffer, or Tris-EDTA buffer before subsequent analysis. In an exemplary embodiment, the nucleic acid material is extracted in water. In some cases, extraction does not comprise nucleic acid purification. In certain embodiments, RNA may be extracted from cells using RNA extraction techniques including, for example, using acid phenol/guanidine isothiocyanate extraction (RNAzol B; Biogenesis), RNeasy RNA preparation kits (Qiagen) or PAXgene (PreAnalytix, Switzerland).

In some embodiments, methods of detecting a presence, absence, or level of a target protein (e.g., biomarker) in the sample obtained from the subject involve detecting protein activity or expression. In some embodiments, the target protein is TL1A, or a binding partner of TL1A such as Death Domain Receptor 3 (DcR3). A target protein may be detected by use of an antibody-based assay, where an antibody specific to the target protein is utilized. In some embodiments, antibody-based detection methods utilize an antibody that binds to any region of target protein. An exemplary method of analysis comprises performing an enzyme-linked immunosorbent assay (ELISA). The ELISA assay may be a sandwich ELISA or a direct ELISA. Another exemplary method of analysis comprises a single molecule array, e.g., Simoa. Other exemplary methods of detection include immunohistochemistry and lateral flow assay. Additional exemplary methods for detecting target protein include, but are not limited to, gel electrophoresis, capillary electrophoresis, high performance liquid chromatography (HPLC), thin layer chromatography (TLC), hyperdiffusion chromatography, and the like, or various immunological methods such as fluid or gel precipitation reactions, immunodiffusion (single or double), immunoelectrophoresis, radioimmunoassay (MA), immunofluorescent assays, and Western blotting. In some embodiments, antibodies, or antibody fragments, are used in methods such as Western blots or immunofluorescence techniques to detect the expressed proteins. The antibody or protein can be immobilized on a solid support for Western blots and immunofluorescence techniques. Suitable solid phase supports or carriers include any support capable of binding an antigen or an antibody. Exemplary supports or carriers include glass, polystyrene, polypropylene, polyethylene, dextran, nylon, amylases, natural and modified celluloses, polyacrylamides, gabbros, and magnetite.

In some cases, a target protein may be detected by detecting binding between the target protein and a binding partner of the target protein. Non-limiting examples of binding partners to TL1A include DcR3, and Tumor necrosis factor receptor superfamily member 25 (TNR25). Exemplary methods of analysis of protein-protein binding comprise performing an assay in vivo or in vitro, or ex vivo. In some instances, the method of analysis comprises an assay such as a co-immunoprecipitation (co-IP), pull-down, cross-linking protein interaction analysis, labeled transfer protein interaction analysis, or Far-western blot analysis, FRET based assay, including, for example FRET-FLIM, a yeast two-hybrid assay, BiFC, or split luciferase assay.

Disclosed herein are methods of detecting a presence or a level of one or more serological markers in a sample obtained from a subject. In some embodiments, the one or more serological markers comprises anti-*Saccharomyces cerevisiae* antibody (ASCA), an anti-neutrophil cytoplasmic antibody (ANCA), antibody against *E. coli* outer membrane porin protein C (anti-OmpC), anti-chitin antibody, pANCA antibody, anti-I2 antibody, and anti-Cbir1 flagellin antibody. In some embodiments, the antibodies comprises immunoglobulin A (IgA), immunoglobulin G (IgG), immunoglobulin E (IgE), or immunoglobulin M (IgM), immunoglobulin D (IgD), or a combination thereof. Any suitable method for detecting a target protein or biomarker disclosed herein may be used to detect a presence, absence, or level of a serological marker. In some embodiments, the presence or the level of the one or more serological markers is detected using an enzyme-linked immunosorbent assay (ELISA), a single molecule array (Simoa Sensitivity®), immunohistochemistry, internal transcribed spacer (ITS) sequencing, or any combination thereof. In some embodiments, the ELISA is a fixed leukocyte ELISA. In some embodiments, the ELISA is a fixed neutrophil ELISA. A fixed leukocyte or neutrophil ELISA may be useful for the detection of certain serological markers, such as those described in Saxon et al., A distinct subset of antineutrophil cytoplasmic antibodies is associated with inflammatory bowel disease, J. Allergy Clin. Immuno. 86:2; 202-210 (August 1990). In some embodiments, ELISA units (EU) are used to measure positivity of a presence or level of a serological marker (e.g., seropositivity), which reflects a percentage of a standard or reference value. In some embodiments, the standard comprises pooled sera obtained from well-characterized patient population (e.g., diagnosed with the same disease or condition the subject has, or is suspected of having) reported as being seropositive for the serological marker of interest. In some embodiments, the control or reference value comprises 10, 20, 30, 40, 50, 60, 70, 80, 90, or 100 EU. In some instances, a quartile sum scores are calculated using, for example, the methods reported in Landers C J, Cohavy O, Misra R. et al., Selected loss of tolerance evidenced by Crohn's disease-associated immune responses to auto- and microbial antigens. Gastroenterology (2002)123:689-699.

Methods of Treatment

Disclosed herein are methods of treating a disease or condition, or a symptom of the disease or condition, in a subject, comprising administrating of therapeutic effective amount of one or more therapeutic agents to the subject. In some embodiments, the one or more therapeutic agents is administered to the subject alone (e.g., standalone therapy). In some embodiments, the one or more therapeutic agents is administered in combination with an additional agent. In some embodiments, the therapeutic agent is a first-line therapy for the disease or condition. In some embodiments, the therapeutic agent is a second-line, third-line, or fourth-line therapy, for the disease or condition.

Therapeutic Agents

Aspects provided herein are methods of treating an inflammatory, fibrostenotic, or fibrotic disease or condition in a subject by administering a therapeutically effective amount of an inhibitor of TNF Superfamily Member 15 (TL1A) activity or expression to the subject, provided a genotype is detected in a sample obtained from the subject. In some cases, the TL1A protein comprises an amino acid sequence provided in any one of SEQ ID NOS: 50-52. In some cases, the TL1A protein comprises an amino acid sequence that is at least or about 70%, 80%, 90%, 91%, 92%, 93%, 94%, 95%, 96%. 97%, 98%, or 99% identical to any one of SEQ ID NOS: 50-52. In some embodiments, the inhibitor of TL1A activity or expression is effective to inhibit TL1A-DR3 binding. In some embodiments, the inhibitor of TL1A activity or expression comprises an allosteric modulator of TL1A. An allosteric modulator of TL1A may indirectly influence the effects TL1A on DR3, or TR6/DcR3 on TL1A or DR3. The inhibitor of TL1A activity or expression may be a direct inhibitor or indirect inhibitor. Non-limiting examples of an inhibitor of TL1A expression include RNA to protein TL1A translation inhibitors, anti-sense oligonucleotides targeting the TNFSF15 mRNA (such as miRNAs, or siRNA), epigenetic editing (such as targeting the DNA-binding domain of TNFSF15, or post-translational modifications of histone tails and/or DNA molecules). Non-limiting examples of an inhibitor of TL1A activity include antagonists to the TL1A receptors, (DR3 and TR6/DcR3), antagonists to TL1A antigen, and antagonists to gene expression products involved in TL1A mediated disease. Antagonists as disclosed herein, may include, but are not limited to, an anti-TL1A antibody, an anti-TL1A-binding antibody fragment, or a small molecule. The small molecule may be a small molecule that binds to TL1A or DR3. The anti-TL1A antibody may be monoclonal or polyclonal. The anti-TL1A antibody may be humanized or chimeric. The anti-TL1A antibody may be a fusion protein. The anti-TL1A antibody may be a blocking anti-TL1A antibody. A blocking antibody blocks binding between two proteins, e.g., a ligand and its receptor. Therefore, a TL1A blocking antibody includes an antibody that prevents binding of TL1A to DR3 and/or TR6/DcR3 receptors. In a non-limiting example, the TL1A blocking antibody binds to DR3. In another example, the TL1A blocking antibody binds to DcR3. In some cases, the TL1A antibody is an anti-TL1A antibody that specifically binds to TL1A. In some cases, the TL1A antibody specifically binds to an epitope of the TL1A protein provided in any one of SEQ ID NOS: 50-52. In some cases, the TL1A protein comprises an amino acid sequence that is at least or about 70%, 80%, 90%, 91%, 92%, 93%, 94%, 95%, 96%. 97%, 98%, or 99% identical to any one of SEQ ID NOS: 50-52. The anti-TL1A antibody may comprise one or more of the antibody sequences of Table 2A or Table 2B. The anti-DR3 antibody may comprise an amino acid sequence that is at least 85% identical to any one of SEQ ID NOS: 258-270 and an amino acid sequence that is at least 85% identical to any one of SEQ ID NOS: 271-275. The anti-DR3 antibody may comprise an amino acid sequence comprising the HCDR1, HCDR2, HCDR3 domains of any one of SEQ ID NOS: 258-270 and the LCDR1, LCDR2, and LCDR3 domains of any one of SEQ ID NOS: 271-275.

In some embodiments, an anti-TL1A antibody comprises a heavy chain comprising three complementarity-determining regions: HCDR1, HCDR2, and HCDR3; and a light chain comprising three complementarity-determining regions: LCDR1, LCDR2, and LCDR3. In some embodiments, the anti-TL1A antibody comprises a HCDR1 comprising SEQ ID NO: 109, a HCDR2 comprising SEQ ID NO: 110, a HCDR3 comprising SEQ ID NO: 111, a LCDR1 comprising SEQ ID NO: 112, a LCDR2 comprising SEQ ID NO: 113, and a LCDR3 comprising SEQ ID NO: 114. In some cases, the anti-TL1A antibody comprises a heavy chain (HC) variable domain comprising SEQ ID NO: 115 and a light chain (LC) variable domain comprising SEQ ID NO: 116.

In some embodiments, the anti-TL1A antibody comprises a HCDR1 comprising SEQ ID NO: 117, a HCDR2 comprising SEQ ID NO: 118, a HCDR3 comprising SEQ ID NO: 119, a LCDR1 comprising SEQ ID NO: 120, a LCDR2 comprising SEQ ID NO: 121, and a LCDR3 comprising SEQ ID NO: 122. In some cases, the anti-TL1A antibody comprises a heavy chain (HC) variable domain comprising SEQ ID NO: 123 and a light chain (LC) variable domain comprising SEQ ID NO: 124.

In some embodiments, the anti-TL1A antibody comprises a HCDR1 comprising SEQ ID NO: 125, a HCDR2 comprising SEQ ID NO: 126, a HCDR3 comprising SEQ ID NO: 127, a LCDR1 comprising SEQ ID NO: 128, a LCDR2 comprising SEQ ID NO: 129, and a LCDR3 comprising SEQ ID NO: 130. In some cases, the anti-TL1A antibody comprises a heavy chain (HC) variable domain comprising SEQ ID NO: 131 and a light chain (LC) variable domain comprising SEQ ID NO: 132.

In some embodiments, the anti-TL1A antibody comprises a HCDR1 comprising SEQ ID NO: 133, a HCDR2 comprising SEQ ID NO: 134, a HCDR3 comprising SEQ ID NO: 135, a LCDR1 comprising SEQ ID NO: 139, a LCDR2 comprising SEQ ID NO: 140, and a LCDR3 comprising SEQ ID NO: 141. In some cases, the anti-TL1A antibody comprises a HCDR1 comprising SEQ ID NO: 136, a HCDR2 comprising SEQ ID NO: 137, a HCDR3 comprising SEQ ID NO: 138, a LCDR1 comprising SEQ ID NO: 139, a LCDR2 comprising SEQ ID NO: 140, and a LCDR3 comprising SEQ ID NO: 141. In some cases, the anti-TL1A antibody comprises a heavy chain (HC) variable domain comprising SEQ ID NO: 142 and a light chain (LC) variable domain comprising SEQ ID NO: 143. In some cases, the anti-TL1A antibody comprises a heavy chain comprising SEQ ID NO: 144. In some cases, the anti-TL1A antibody comprises a light chain comprising SEQ ID NO: 145.

In some embodiments, the anti-TL1A antibody comprises a HCDR1 comprising SEQ ID NO: 146, a HCDR2 comprising SEQ ID NO: 147, a HCDR3 comprising SEQ ID NO: 148, a LCDR1 comprising SEQ ID NO: 149, a LCDR2 comprising SEQ ID NO: 150, and a LCDR3 comprising SEQ ID NO: 151. In some cases, the anti-TL1A antibody comprises a heavy chain (HC) variable domain comprising SEQ ID NO: 152 and a light chain (LC) variable domain comprising SEQ ID NO: 153.

In some embodiments, the anti-TL1A antibody comprises a HCDR1 comprising SEQ ID NO: 154, a HCDR2 comprising SEQ ID NO: 155, a HCDR3 comprising SEQ ID NO: 156, a LCDR1 comprising SEQ ID NO: 157, a LCDR2 comprising SEQ ID NO: 158, and a LCDR3 comprising SEQ ID NO: 159. In some cases, the anti-TL1A antibody comprises a heavy chain (HC) variable domain comprising SEQ ID NO: 160 and a light chain (LC) variable domain comprising SEQ ID NO: 161.

In some embodiments, the anti-TL1A antibody comprises a HCDR1 comprising SEQ ID NO: 162, a HCDR2 comprising SEQ ID NO: 164, a HCDR3 comprising SEQ ID NO: 165, a LCDR1 comprising SEQ ID NO: 167, a LCDR2 comprising SEQ ID NO: 169, and a LCDR3 comprising SEQ ID NO: 170. In some cases, the anti-TL1A antibody comprises a heavy chain (HC) variable domain comprising SEQ ID NO: 171 and a light chain (LC) variable domain comprising SEQ ID NO: 175. In some cases, the anti-TL1A antibody comprises a heavy chain (HC) variable domain comprising SEQ ID NO: 171 and a light chain (LC) variable domain comprising SEQ ID NO: 176. In some cases, the anti-TL1A antibody comprises a heavy chain (HC) variable domain comprising SEQ ID NO: 171 and a light chain (LC) variable domain comprising SEQ ID NO: 177. In some cases, the anti-TL1A antibody comprises a heavy chain (HC) variable domain comprising SEQ ID NO: 171 and a light chain (LC) variable domain comprising SEQ ID NO: 178.

In some embodiments, the anti-TL1A antibody comprises a HCDR1 comprising SEQ ID NO: 162, a HCDR2 comprising SEQ ID NO: 164, a HCDR3 comprising SEQ ID NO: 165, a LCDR1 comprising SEQ ID NO: 168, a LCDR2 comprising SEQ ID NO: 169, and a LCDR3 comprising SEQ ID NO: 170. In some cases, the anti-TL1A antibody comprises a heavy chain (HC) variable domain comprising SEQ ID NO: 171 and a light chain (LC) variable domain comprising SEQ ID NO: 179. In some cases, the anti-TL1A antibody comprises a heavy chain (HC) variable domain comprising SEQ ID NO: 171 and a light chain (LC) variable domain comprising SEQ ID NO: 180. In some cases, the anti-TL1A antibody comprises a heavy chain (HC) variable domain comprising SEQ ID NO: 171 and a light chain (LC) variable domain comprising SEQ ID NO: 181. In some cases, the anti-TL1A antibody comprises a heavy chain (HC) variable domain comprising SEQ ID NO: 171 and a light chain (LC) variable domain comprising SEQ ID NO: 182.

In some embodiments, the anti-TL1A antibody comprises a HCDR1 comprising SEQ ID NO: 162, a HCDR2 comprising SEQ ID NO: 164, a HCDR3 comprising SEQ ID NO: 165, a LCDR1 comprising SEQ ID NO: 167, a LCDR2 comprising SEQ ID NO: 169, and a LCDR3 comprising SEQ ID NO: 170. In some cases, the anti-TL1A antibody comprises a heavy chain (HC) variable domain comprising SEQ ID NO: 172 and a light chain (LC) variable domain comprising SEQ ID NO: 175. In some cases, the anti-TL1A antibody comprises a heavy chain (HC) variable domain comprising SEQ ID NO: 172 and a light chain (LC) variable domain comprising SEQ ID NO: 176. In some cases, the anti-TL1A antibody comprises a heavy chain (HC) variable domain comprising SEQ ID NO: 172 and a light chain (LC) variable domain comprising SEQ ID NO: 177. In some cases, the anti-TL1A antibody comprises a heavy chain (HC) variable domain comprising SEQ ID NO: 172 and a light chain (LC) variable domain comprising SEQ ID NO: 178.

In some embodiments, the anti-TL1A antibody comprises a HCDR1 comprising SEQ ID NO: 162, a HCDR2 comprising SEQ ID NO: 164, a HCDR3 comprising SEQ ID NO: 165, a LCDR1 comprising SEQ ID NO: 168, a LCDR2 comprising SEQ ID NO: 169, and a LCDR3 comprising SEQ ID NO: 170. In some cases, the anti-TL1A antibody comprises a heavy chain (HC) variable domain comprising SEQ ID NO: 172 and a light chain (LC) variable domain comprising SEQ ID NO: 179. In some cases, the anti-TL1A antibody comprises a heavy chain (HC) variable domain comprising SEQ ID NO: 172 and a light chain (LC) variable domain comprising SEQ ID NO: 180. In some cases, the anti-TL1A antibody comprises a heavy chain (HC) variable domain comprising SEQ ID NO: 172 and a light chain (LC) variable domain comprising SEQ ID NO: 181. In some cases, the anti-TL1A antibody comprises a heavy chain (HC) variable domain comprising SEQ ID NO: 172 and a light chain (LC) variable domain comprising SEQ ID NO: 182.

In some embodiments, the anti-TL1A antibody comprises a HCDR1 comprising SEQ ID NO: 163, a HCDR2 comprising SEQ ID NO: 164, a HCDR3 comprising SEQ ID NO: 166, a LCDR1 comprising SEQ ID NO: 167, a LCDR2 comprising SEQ ID NO: 169, and a LCDR3 comprising SEQ ID NO: 170. In some cases, the anti-TL1A antibody comprises a heavy chain (HC) variable domain comprising SEQ ID NO: 173 and a light chain (LC) variable domain comprising SEQ ID NO: 175. In some cases, the anti-TL1A antibody comprises a heavy chain (HC) variable domain comprising SEQ ID NO: 173 and a light chain (LC) variable domain comprising SEQ ID NO: 176. In some cases, the anti-TL1A antibody comprises a heavy chain (HC) variable domain comprising SEQ ID NO: 173 and a light chain (LC) variable domain comprising SEQ ID NO: 177. In some cases, the anti-TL1A antibody comprises a heavy chain (HC) variable domain comprising SEQ ID NO: 173 and a light chain (LC) variable domain comprising SEQ ID NO: 178. In some cases, the anti-TL1A antibody comprises a heavy chain (HC) variable domain comprising SEQ ID NO: 173 and a light chain (LC) variable domain comprising SEQ ID NO: 179. In some cases, the anti-TL1A antibody comprises a heavy chain (HC) variable domain comprising SEQ ID NO: 173 and a light chain (LC) variable domain comprising SEQ ID NO: 180. In some cases, the anti-TL1A antibody comprises a heavy chain (HC) variable domain comprising SEQ ID NO: 173 and a light chain (LC) variable domain comprising SEQ ID NO: 181. In some cases, the anti-TL1A antibody comprises a heavy chain (HC) variable domain comprising SEQ ID NO: 173 and a light chain (LC) variable domain comprising SEQ ID NO: 182.

In some embodiments, the anti-TL1A antibody comprises a HCDR1 comprising SEQ ID NO: 163, a HCDR2 comprising SEQ ID NO: 164, a HCDR3 comprising SEQ ID NO: 166, a LCDR1 comprising SEQ ID NO: 168, a LCDR2 comprising SEQ ID NO: 169, and a LCDR3 comprising SEQ ID NO: 170. In some cases, the anti-TL1A antibody comprises a heavy chain (HC) variable domain comprising SEQ ID NO: 174 and a light chain (LC) variable domain comprising SEQ ID NO: 179. In some cases, the anti-TL1A antibody comprises a heavy chain (HC) variable domain comprising SEQ ID NO: 174 and a light chain (LC) variable domain comprising SEQ ID NO: 180. In some cases, the anti-TL1A antibody comprises a heavy chain (HC) variable domain comprising SEQ ID NO: 174 and a light chain (LC) variable domain comprising SEQ ID NO: 181. In some cases, the anti-TL1A antibody comprises a heavy chain (HC) variable domain comprising SEQ ID NO: 174 and a light chain (LC) variable domain comprising SEQ ID NO: 182. In some cases, the anti-TL1A antibody comprises a heavy chain (HC) variable domain comprising SEQ ID NO: 174 and a light chain (LC) variable domain comprising SEQ ID NO: 175. In some cases, the anti-TL1A antibody comprises a heavy chain (HC) variable domain comprising SEQ ID NO: 174 and a light chain (LC) variable domain comprising SEQ ID NO: 176. In some cases, the anti-TL1A antibody comprises a heavy chain (HC) variable domain comprising SEQ ID NO: 174 and a light chain (LC) variable domain comprising SEQ ID NO: 177. In some cases, the anti-TL1A antibody comprises a heavy chain (HC) variable domain comprising SEQ ID NO: 174 and a light chain (LC) variable domain comprising SEQ ID NO: 178.

In some embodiments, the anti-TL1A antibody comprises a HCDR1 comprising SEQ ID NO: 183, a HCDR2 comprising SEQ ID NO: 184, a HCDR3 comprising SEQ ID NO: 185, a LCDR1 comprising SEQ ID NO: 186, a LCDR2 comprising SEQ ID NO: 187, and a LCDR3 comprising SEQ ID NO: 188. In some cases, the anti-TL1A antibody comprises a heavy chain (HC) variable domain comprising SEQ ID NO: 189 and a light chain (LC) variable domain comprising SEQ ID NO: 194. In some cases, the anti-TL1A antibody comprises a heavy chain (HC) variable domain comprising SEQ ID NO: 189 and a light chain (LC) variable domain comprising SEQ ID NO: 195. In some cases, the anti-TL1A antibody comprises a heavy chain (HC) variable domain comprising SEQ ID NO: 189 and a light chain (LC) variable domain comprising SEQ ID NO: 196. In some cases, the anti-TL1A antibody comprises a heavy chain (HC) variable domain comprising SEQ ID NO: 189 and a light chain (LC) variable domain comprising SEQ ID NO: 197. In some cases, the anti-TL1A antibody comprises a heavy chain (HC) variable domain comprising SEQ ID NO: 190 and a light chain (LC) variable domain comprising SEQ ID NO: 194. In some cases, the anti-TL1A antibody comprises a heavy chain (HC) variable domain comprising SEQ ID NO: 190 and a light chain (LC) variable domain comprising SEQ ID NO: 195. In some cases, the anti-TL1A antibody comprises a heavy chain (HC) variable domain comprising SEQ ID NO: 190 and a light chain (LC) variable domain comprising SEQ ID NO: 196. In some cases, the anti-TL1A antibody comprises a heavy chain (HC) variable domain comprising SEQ ID NO: 190 and a light chain (LC) variable domain comprising SEQ ID NO: 197. In some cases, the anti-TL1A antibody comprises a heavy chain (HC) variable domain comprising SEQ ID NO: 191 and a light chain (LC) variable domain comprising SEQ ID NO: 194. In some cases, the anti-TL1A antibody comprises a heavy chain (HC) variable domain comprising SEQ ID NO: 191 and a light chain (LC) variable domain comprising SEQ ID NO: 195. In some cases, the anti-TL1A antibody comprises a heavy chain (HC) variable domain comprising SEQ ID NO: 191 and a light chain (LC) variable domain comprising SEQ ID NO: 196. In some cases, the anti-TL1A antibody comprises a heavy chain (HC) variable domain comprising SEQ ID NO: 191 and a light chain (LC) variable domain comprising SEQ ID NO: 197. In some cases, the anti-TL1A antibody comprises a heavy chain (HC) variable domain comprising SEQ ID NO: 192 and a light chain (LC) variable domain comprising SEQ ID NO: 194. In some cases, the anti-TL1A antibody comprises a heavy chain (HC) variable domain comprising SEQ ID NO: 192 and a light chain (LC) variable domain comprising SEQ ID NO: 195. In some cases, the anti-TL1A antibody comprises a heavy chain (HC) variable domain comprising SEQ ID NO: 192 and a light chain (LC) variable domain comprising SEQ ID NO: 196. In some cases, the anti-TL1A antibody comprises a heavy chain (HC) variable domain comprising SEQ ID NO: 192 and a light chain (LC) variable domain comprising SEQ ID NO: 197. In some cases, the anti-TL1A antibody comprises a heavy chain (HC) variable domain comprising SEQ ID NO: 193 and a light chain (LC) variable domain comprising SEQ ID NO: 194. In some cases, the anti-TL1A antibody comprises a heavy chain (HC) variable domain comprising SEQ ID NO: 193 and a light chain (LC) variable domain comprising SEQ ID NO: 195. In some cases, the anti-TL1A antibody comprises a heavy chain (HC) variable domain comprising SEQ ID NO: 193 and a light chain (LC) variable domain comprising SEQ ID NO: 196. In some cases, the anti-TL1A antibody comprises a heavy chain (HC) variable domain comprising SEQ ID NO: 193 and a light chain (LC) variable domain comprising SEQ ID NO: 197.

In some embodiments, the anti-TL1A antibody comprises a HCDR1 comprising SEQ ID NO: 198, a HCDR2 comprising SEQ ID NO: 199, a HCDR3 comprising SEQ ID NO: 200, a LCDR1 comprising SEQ ID NO: 201, a LCDR2 comprising SEQ ID NO: 202, and a LCDR3 comprising SEQ ID NO: 203. In some cases, the anti-TL1A antibody comprises a heavy chain (HC) variable domain comprising SEQ ID NO: 204 and a light chain (LC) variable domain comprising SEQ ID NO: 205. In some cases, the anti-TL1A antibody comprises a heavy chain (HC) variable domain comprising SEQ ID NO: 206 and a light chain (LC) variable domain comprising SEQ ID NO: 207. In some cases, the anti-TL1A antibody comprises a heavy chain (HC) variable domain comprising SEQ ID NO: 208 and a light chain (LC) variable domain comprising SEQ ID NO: 209. In some cases, the anti-TL1A antibody comprises a heavy chain (HC) variable domain comprising SEQ ID NO: 210 and a light chain (LC) variable domain comprising SEQ ID NO: 211. In some cases, the anti-TL1A antibody comprises a heavy chain (HC) variable domain comprising SEQ ID NO: 212 and a light chain (LC) variable domain comprising SEQ ID NO: 213. In some cases, the anti-TL1A antibody comprises a heavy chain (HC) variable domain comprising SEQ ID NO: 214 and a light chain (LC) variable domain comprising SEQ ID NO: 215. In some cases, the anti-TL1A antibody comprises a heavy chain (HC) variable domain comprising SEQ ID NO: 216 and a light chain (LC) variable domain comprising SEQ ID NO: 217. In some cases, the anti-TL1A antibody comprises a heavy chain (HC) variable domain comprising SEQ ID NO: 218 and a light chain (LC) variable domain comprising SEQ ID NO: 219. In some cases, the anti-TL1A antibody comprises a heavy chain (HC) variable domain comprising SEQ ID NO: 220 and a light chain (LC) variable domain comprising SEQ ID NO: 221. In some cases, the anti-TL1A antibody comprises a heavy chain (HC) variable domain comprising SEQ ID NO: 222 and a light chain (LC) variable domain comprising SEQ ID NO: 223. In some cases, the anti-TL1A antibody comprises a heavy chain (HC) variable domain comprising SEQ ID NO: 224 and a light chain (LC) variable domain comprising SEQ ID NO: 225. In some cases, the anti-TL1A antibody comprises a heavy chain (HC) variable domain comprising SEQ ID NO: 226 and a light chain (LC) variable domain comprising SEQ ID NO: 227.

In some embodiments, the anti-TL1A antibody comprises a HCDR1 comprising SEQ ID NO: 228, a HCDR2 comprising SEQ ID NO: 229, a HCDR3 comprising SEQ ID NO: 230, a LCDR1 comprising SEQ ID NO: 231, a LCDR2 comprising SEQ ID NO: 232, and a LCDR3 comprising SEQ ID NO: 233. In some cases, the anti-TL1A antibody comprises a heavy chain (HC) variable domain comprising SEQ ID NO: 234 and a light chain (LC) variable domain comprising SEQ ID NO: 235.

In some embodiments, the anti-TL1A antibody comprises a HCDR1 comprising SEQ ID NO: 236, a HCDR2 comprising SEQ ID NO: 237, a HCDR3 comprising SEQ ID NO: 238, a LCDR1 comprising SEQ ID NO: 239, a LCDR2 comprising SEQ ID NO: 240, and a LCDR3 comprising SEQ ID NO: 241. In some cases, the anti-TL1A antibody comprises a heavy chain (HC) variable domain comprising SEQ ID NO: 242 and a light chain (LC) variable domain comprising SEQ ID NO: 243.

In some embodiments, the anti-TL1A antibody comprises a HCDR1 comprising SEQ ID NO: 246, a HCDR2 comprising SEQ ID NO: 247, a HCDR3 comprising SEQ ID NO: 248, a LCDR1 comprising SEQ ID NO: 249, a LCDR2 comprising SEQ ID NO: 250, and a LCDR3 comprising SEQ ID NO: 251. In some cases, the anti-TL1A antibody comprises a heavy chain (HC) variable domain comprising SEQ ID NO: 244 and a light chain (LC) variable domain comprising SEQ ID NO: 245. In some cases, the anti-TL1A antibody comprises a heavy chain (HC) variable domain comprising SEQ ID NO: 252 and a light chain (LC) variable domain comprising SEQ ID NO: 253. In some cases, the anti-TL1A antibody comprises a heavy chain (HC) variable domain comprising SEQ ID NO: 254 and a light chain (LC) variable domain comprising SEQ ID NO: 255. In some cases, the anti-TL1A antibody comprises a heavy chain (HC) variable domain comprising SEQ ID NO: 256 and a light chain (LC) variable domain comprising SEQ ID NO: 257.

In some embodiments, the anti-TL1A antibody comprises a HCDR1 comprising SEQ ID NO: 276, a HCDR2 comprising SEQ ID NO: 277, a HCDR3 comprising SEQ ID NO: 278, a LCDR1 comprising SEQ ID NO: 279, a LCDR2 comprising SEQ ID NO: 280, and a LCDR3 comprising SEQ ID NO: 281. In some cases, the anti-TL1A antibody comprises a heavy chain (HC) variable domain comprising SEQ ID NO: 282 and a light chain (LC) variable domain comprising SEQ ID NO: 283.

In some embodiments, the anti-TL1A antibody comprises a HCDR1 comprising SEQ ID NO: 284, a HCDR2 comprising SEQ ID NO: 285, a HCDR3 comprising SEQ ID NO: 286, a LCDR1 comprising SEQ ID NO: 287, a LCDR2 comprising SEQ ID NO: 288, and a LCDR3 comprising SEQ ID NO: 299. In some cases, the anti-TL1A antibody comprises a heavy chain (HC) variable domain comprising SEQ ID NO: 290 and a light chain (LC) variable domain comprising SEQ ID NO: 291.

In some embodiments, the anti-TL1A antibody is A100. In some embodiments, the anti-TL1A antibody is A101. In some embodiments, the anti-TL1A antibody is A102. In some embodiments, the anti-TL1A antibody is A103. In some embodiments, the anti-TL1A antibody is A104. In some embodiments, the anti-TL1A antibody is A105. In some embodiments, the anti-TL1A antibody is A106. In some embodiments, the anti-TL1A antibody is A107. In some embodiments, the anti-TL1A antibody is A108. In some embodiments, the anti-TL1A antibody is A109. In some embodiments, the anti-TL1A antibody is A110. In some embodiments, the anti-TL1A antibody is A111. In some embodiments, the anti-TL1A antibody is A112. In some embodiments, the anti-TL1A antibody is A113. In some embodiments, the anti-TL1A antibody is A114. In some embodiments, the anti-TL1A antibody is A115. In some embodiments, the anti-TL1A antibody is A116. In some embodiments, the anti-TL1A antibody is A117. In some embodiments, the anti-TL1A antibody is A118. In some embodiments, the anti-TL1A antibody is A119. In some embodiments, the anti-TL1A antibody is A120. In some embodiments, the anti-TL1A antibody is A121. In some embodiments, the anti-TL1A antibody is A122. In some embodiments, the anti-TL1A antibody is A123. In some embodiments, the anti-TL1A antibody is A124. In some embodiments, the anti-TL1A antibody is A125. In some embodiments, the anti-TL1A antibody is A126. In some embodiments, the anti-TL1A antibody is A127. In some embodiments, the anti-TL1A antibody is A128. In some embodiments, the anti-TL1A antibody is A129. In some embodiments, the anti-TL1A antibody is A130. In some embodiments, the anti-TL1A antibody is A131. In some embodiments, the anti-TL1A antibody is A132. In some embodiments, the anti-TL1A antibody is A133. In some embodiments, the anti-TL1A antibody is A134. In some embodiments, the anti-TL1A antibody is A135. In some embodiments, the anti-TL1A antibody is A136. In some embodiments, the anti-TL1A antibody is A137. In some embodiments, the anti-TL1A antibody is A138. In some embodiments, the anti-TL1A antibody is A139. In some embodiments, the anti-TL1A antibody is A140. In some embodiments, the anti-TL1A antibody is A141. In some embodiments, the anti-TL1A antibody is A142. In some embodiments, the anti-TL1A antibody is A143. In some embodiments, the anti-TL1A antibody is A144. In some embodiments, the anti-TL1A antibody is A145. In some embodiments, the anti-TL1A antibody is A146. In some embodiments, the anti-TL1A antibody is A147. In some embodiments, the anti-TL1A antibody is A148. In some embodiments, the anti-TL1A antibody is A149. In some embodiments, the anti-TL1A antibody is A150. In some embodiments, the anti-TL1A antibody is A151. In some embodiments, the anti-TL1A antibody is A152. In some embodiments, the anti-TL1A antibody is A153. In some embodiments, the anti-TL1A antibody is A154. In some embodiments, the anti-TL1A antibody is A155. In some embodiments, the anti-TL1A antibody is A156. In some embodiments, the anti-TL1A antibody is A157. In some embodiments, the anti-TL1A antibody is A158. In some embodiments, the anti-TL1A antibody is A159. In some embodiments, the anti-TL1A antibody is A160. In some embodiments, the anti-TL1A antibody is A161. In some embodiments, the anti-TL1A antibody is A162. In some embodiments, the anti-TL1A antibody is A163. In some embodiments, the anti-TL1A antibody is A164. In some embodiments, the anti-TL1A antibody is A165. In some embodiments, the anti-TL1A antibody is A166. In some embodiments, the anti-TL1A antibody is A167. In some embodiments, the anti-TL1A antibody is A168. In some embodiments, the anti-TL1A antibody is A169. In some embodiments, the anti-TL1A antibody is A170. In some embodiments, the anti-TL1A antibody is A171. In some embodiments, the anti-TL1A antibody is A172. In some embodiments, the anti-TL1A antibody is A173. In some embodiments, the anti-TL1A antibody is A174. In some embodiments, the anti-TL1A antibody is A175. In some embodiments, the anti-TL1A antibody is A176. In some embodiments, the anti-TL1A antibody is A177. In some embodiments, the anti-DR3 is A178. In some embodiments, the anti-DR3 is A179. In some embodiments, the anti-DR3 is A180. In some embodiments, the anti-DR3 is A181. In some embodiments, the anti-DR3 is A182. In some embodiments, the anti-DR3 is A183. In some embodiments, the anti-DR3 is A184. In some embodiments, the anti-DR3 is A185. In some embodiments, the anti-DR3 is A186. In some embodiments, the anti-DR3 is A187. In some embodiments, the anti-DR3 is A188. In some embodiments, the anti-DR3 is A189. In some embodiments, the anti-DR3 is A190. In some embodiments, the anti-DR3 is A191. In some embodiments, the anti-DR3 is A192. In some embodiments, the anti-DR3 is A193. In some embodiments, the anti-DR3 is A194. In some embodiments, the anti-DR3 is A195. In some embodiments, the anti-DR3 is A196. In some embodiments, the anti-DR3 is A197. In some embodiments, the anti-DR3 is A198. In some embodiments, the anti-DR3 is A199. In some embodiments, the anti-DR3 is A200. In some embodiments, the anti-DR3 is A201. In some embodiments, the anti-DR3 is A202. In some embodiments, the anti-DR3 is A203. In some embodiments, the anti-DR3 is A204. In some embodiments, the anti-DR3 is A205. In some embodiments, the anti-DR3 is A206. In some embodiments, the anti-DR3 is A207. In some embodiments, the anti-DR3 is A208. In some embodiments, the anti-DR3 is A209. In some embodiments, the anti-DR3 is A210. In some embodiments, the anti-DR3 is A211. In some embodiments, the anti-DR3 is A212. In some embodiments, the anti-DR3 is A213. In some embodiments, the anti-DR3 is A214. In some embodiments, the anti-DR3 is A215. In some embodiments, the anti-DR3 is A216. In some embodiments, the anti-DR3 is A217. In some embodiments, the anti-DR3 is A218. In some embodiments, the anti-DR3 is A219. In some embodiments, the anti-DR3 is A220. In some embodiments, the anti-DR3 is A221. In some embodiments, the anti-DR3 is A222. In some embodiments, the anti-DR3 is A223. In some embodiments, the anti-DR3 is A224. In some embodiments, the anti-DR3 is A225. In some embodiments, the anti-DR3 is A226. In some embodiments, the anti-DR3 is A227. In some embodiments, the anti-DR3 is A228. In some embodiments, the anti-DR3 is A229. In some embodiments, the anti-DR3 is A230. In some embodiments, the anti-DR3 is A231. In some embodiments, the anti-DR3 is A232. In some embodiments, the anti-DR3 is A233. In some embodiments, the anti-DR3 is A234. In some embodiments, the anti-DR3 is A235. In some embodiments, the anti-DR3 is A236. In some embodiments, the anti-DR3 is A237. In some embodiments, the anti-DR3 is A238. In some embodiments, the anti-DR3 is A239. In some embodiments, the anti-DR3 is A240. In some embodiments, the anti-DR3 is A241. In some embodiments, the anti-DR3 is A242.

In some cases, the anti-TL1A antibody binds to at least one or more of the same residues of human TL1A as an antibody described herein. For example, the anti-TL1A antibody binds to at least one or more of the same residues of human TL1A as an antibody selected from A100-A177. In some cases, the anti-TL1A antibody binds to the same epitope of human TL1A as an antibody selected from A100-A177. In some cases, the anti-TL1A antibody binds to the same region of human TL1A as an antibody selected from A100-A177.

In some embodiments, the anti-TL1A antibody comprises any one of the following embodiments 1-547 below.

1. An antibody or antigen-binding fragment that specifically binds to TL1A, comprising: a heavy chain variable region comprising four heavy chain framework regions (HFR1, HFR2, HFR3, and HFR4), and three heavy chain complementarity-determining regions (HCDR1, HCDR2, and HCDR3), the heavy chain variable region comprising:

(a) a HFR1 selected from: (i) a HFR1 comprising SEQ ID NO: 100100, (ii) a HFR1 comprising SEQ ID NO: 100108, and (iii) a HFR1 comprising an amino acid sequence that differs from a sequence selected from the group consisting of SEQ ID NOS: 100100 and 100108 by up to five, four, three, or two amino acids, (b) a HFR2 selected from: (i) a HFR2 comprising SEQ ID NO: 100101, and (ii) a HFR2 comprising an amino acid sequence that differs from SEQ ID NO: by up to five, four, three, or two amino acids, (c) a HFR3 selected from: (i) a HFR3 comprising SEQ ID NO: 100102, (ii) a HFR3 comprising SEQ ID NO: 100109, and (iii) a HFR3 comprising an amino acid sequence that differs from a sequence selected from the group consisting of SEQ ID NOS: 100102 and 100109 by up to five, four, three, or two amino acids, (d) a HFR4 selected from: (i) a HFR4 comprising SEQ ID NO: 100103, and (ii) a HFR4 comprising an amino acid sequence that differs from SEQ ID NO: 100103 by up to five, four, three, or two amino acids, (e) a HCDR1 selected from: (i) a HCDR1 comprising SEQ ID NO: 1009, (ii) a HCDR1 comprising SEQ ID NO: 100150, wherein $X_1$ is selected from D and E, $X_2$ is selected from I, P and V, $X_3$ is selected from G, Q, S, and V, $X_4$ is selected from F and Y, and $X_5$ is selected from I and M, (iii) a HCDR1 selected from SEQ ID NOS: 100200-100295, and (iv) a HCDR1 comprising an amino acid sequence that differs from a sequence selected from the group consisting of SEQ ID NOS: 1009, 100150 and 100200-100295 by up to five, four, three, or two amino acids, (f) a HCDR2 selected from: (i) a HCDR2 comprising SEQ ID NO: 10012, and (ii) a HCDR2 comprising an amino acid sequence that differs from SEQ ID NO: 10012 by up to five, four, three, or two amino acids, and (g) a HCDR3 selected from (i) a HCDR3 comprising SEQ ID NO: 10015, (ii) a HCDR3 comprising SEQ ID NO: 100152, wherein $X_1$ is selected from L and M, and $X_2$ is selected from E, I, K, L, M, Q, T, V, W, and Y, (iii) a HCDR3 selected from SEQ ID NOS: 100296-100314, and (iv) a HCDR3 comprising an amino acid sequence that differs from a sequence selected from the group consisting of SEQ ID NOS: 10015, 100152 and 100296-100314 by up to five, four, three, or two amino acids; and a light chain variable region comprising four light chain framework regions (LFR1, LFR2, LFR3, and LFR4), and three light chain complementarity-determining regions (LCDR1, LCDR2, and LCDR3), the light chain variable region comprising:

(a) a LFR1 selected from: (i) a LFR1 comprising SEQ ID NO: 100104, and (ii) a LFR1 comprising an amino acid sequence that differs from SEQ ID NO: 100104 by up to five, four, three, or two amino acids, (b) a LFR2 selected from: (i) a LFR2 comprising SEQ ID NO: 100105, and (ii) a LFR2 comprising an amino acid sequence that differs from SEQ ID NO: 100105 by up to five, four, three, or two amino acids, (c) a LFR3 selected from: (i) a LFR3 comprising SEQ ID NO: 100106, (ii) a LFR3 comprising SEQ ID NO: 100110, and (iii) a LFR3 comprising an amino acid sequence that differs from a sequence selected from the group consisting of SEQ ID NOS: 100106 and 100110 by up to five, four, three, or two amino acids, (d) a LFR4 selected from: (i) a LFR4 comprising SEQ ID NO: 100107, and (ii) a LFR4 comprising an amino acid sequence that differs from SEQ ID NO: 100107 by up to five, four, three, or two amino acids, (e) a LCDR1 selected from: (i) a LCDR1 comprising SEQ ID NO: 10018, and (ii) a LCDR1 comprising an amino acid sequence that differs from SEQ ID NO: 10018 by up to five, four, three, or two amino acids, (f) a LCDR2 selected from: (i) a LCDR2 comprising SEQ ID NO: 10021, and (ii) a LCDR2 comprising an amino acid sequence that differs from SEQ ID NO: 10021 by up to five, four, three, or two amino acids, and (g) a LCDR3 selected from (i) a LCDR3 comprising SEQ ID NO: 10024, (ii) a LCDR3 comprising SEQ ID NO: 100155, wherein $X_1$ is selected from Q and N, $X_2$ is selected from D, E, H, N, Q, and S, $X_3$ is selected from A and G, and $X_4$ is selected from D, F, K, N, R, S, and T, (iii) a LCDR3 selected from SEQ ID NOS: 100315-100482, and (iv) a LCDR3 comprising an amino acid sequence that differs from a sequence selected from the group consisting of SEQ ID NOS: 10024, 100155, and 100315-100482 by up to five, four, three, or two amino acids.

2. The antibody or antigen-binding fragment of embodiment 1, provided that the HFR1 comprises SEQ ID NO: 100100.

3. The antibody or antigen-binding fragment of embodiment 1, provided that the HFR1 comprises SEQ ID NO: 100108.

4. The antibody or antigen-binding fragment of embodiment 1, provided that the HFR1 comprises an amino acid sequence that differs from SEQ ID NO: 100100 by up to five, four, three, or two amino acids.

5. The antibody or antigen-binding fragment of embodiment 1, provided that the HFR1 comprises an amino acid sequence that differs from SEQ ID NO: 100108 by up to five, four, three, or two amino acids.

6. The antibody or antigen-binding fragment of any of embodiments 1-5, provided that the HFR2 comprises SEQ ID NO: 100101.

7. The antibody or antigen-binding fragment of any of embodiments 1-5, provided that the HFR2 comprises an amino acid sequence that differs from SEQ ID NO: 100101 by up to five, four, three, or two amino acids.

8. The antibody or antigen-binding fragment of any of embodiments 1-7, provided that the HFR3 comprises SEQ ID NO: 100102.

9. The antibody or antigen-binding fragment of any of embodiments 1-7, provided that the HFR3 comprises SEQ ID NO: 100109.

10. The antibody or antigen-binding fragment of any of embodiments 1-7, provided that the HFR3 comprises an amino acid sequence that differs from SEQ ID NO: 100102 by up to five, four, three, or two amino acids.

11. The antibody or antigen-binding fragment of any of embodiments 1-7, provided that the HFR3 comprises an amino acid sequence that differs from SEQ ID NO: 100109 by up to five, four, three, or two amino acids.

12. The antibody or antigen-binding fragment of any of embodiments 1-11, provided that the HFR4 comprises SEQ ID NO: 100103.

13. The antibody or antigen-binding fragment of any of embodiments 1-11, provided that the HFR4 comprises an amino acid sequence that differs from SEQ ID NO: 100103 by up to five, four, three, or two amino acids.

14. The antibody or antigen-binding fragment of any of embodiments 1-13, provided that the HCDR1 comprises SEQ ID NO: 1009.

15. The antibody or antigen-binding fragment of any of embodiments 1-13, provided that the HCDR1 comprises SEQ ID NO: 100150.
16. The antibody or antigen-binding fragment of embodiment 15, provided that $X_1$ is E.
17. The antibody or antigen-binding fragment of embodiment 15 or embodiment 16, provided that $X_2$ is selected from P and V.
18. The antibody or antigen-binding fragment of any of embodiments 15-17, provided that $X_3$ is selected from G, S, and V.
19. The antibody or antigen-binding fragment of any of embodiments 15-18, provided that $X_4$ is F.
20. The antibody or antigen-binding fragment of any of embodiments 15-19, provided that $X_5$ is I.
21. The antibody or antigen-binding fragment of any of embodiments 1-13, provided that the HCDR1 comprises an amino acid sequence selected from SEQ ID NOS: 100200-100295.
22. The antibody or antigen-binding fragment of any of embodiments 1-21, provided that the HCDR2 comprises SEQ ID NO: 10012.
23. The antibody or antigen-binding fragment of any of embodiments 1-21, provided that the HCDR2 comprises an amino acid sequence that differs from SEQ ID NO: 10012 by up to five, four, three, or two amino acids.
24. The antibody or antigen-binding fragment of any of embodiments 1-23, provided that the HCDR3 comprises SEQ ID NO: 10015.
25. The antibody or antigen-binding fragment of any of embodiments 1-23, provided that the HCDR3 comprises SEQ ID NO: 100152.
26. The antibody or antigen-binding fragment of embodiment 25, provided that $X_1$ is M.
27. The antibody or antigen-binding fragment of embodiment 25 or embodiment 26, provided that $X_2$ is selected from E, I, K, L, M, Q, T, W, and Y.
28. The antibody or antigen-binding fragment of any of embodiments 1-23, provided that the HCDR3 comprises a sequence selected from SEQ ID NOS: 100296-100314.
29. The antibody or antigen-binding fragment of any of embodiments 1-28, provided that the LFR1 comprises SEQ ID NO: 100104.
30. The antibody or antigen-binding fragment of any of embodiments 1-28, provided that the LFR1 comprises an amino acid sequence that differs from SEQ ID NO: 100104 by up to five, four, three, or two amino acids.
31. The antibody or antigen-binding fragment of any of embodiments 1-30, provided that the LFR2 comprises SEQ ID NO: 100105.
32. The antibody or antigen-binding fragment of any of embodiments 1-30, provided that the LFR2 comprises an amino acid sequence that differs from SEQ ID NO: 100105 by up to five, four, three, or two amino acids.
33. The antibody or antigen-binding fragment of any of embodiments 1-32, provided that the LFR3 comprises SEQ ID NO: 100106.
34. The antibody or antigen-binding fragment of any of embodiments 1-32, provided that the LFR3 comprises SEQ ID NO: 100110.
35. The antibody or antigen-binding fragment of any of embodiments 1-32, provided that the LFR3 comprises an amino acid sequence that differs from SEQ ID NO: 100106 by up to five, four, three, or two amino acids.
36. The antibody or antigen-binding fragment of any of embodiments 1-32, provided that the LFR3 comprises an amino acid sequence that differs from SEQ ID NO: 100110 by up to five, four, three, or two amino acids.
37. The antibody or antigen-binding fragment of any of embodiments 1-36, provided that the LFR4 comprises SEQ ID NO: 100107.
38. The antibody or antigen-binding fragment of any of embodiments 1-36, provided that the LFR4 comprises an amino acid sequence that differs from SEQ ID NO: 100107 by up to five, four, three, or two amino acids.
39. The antibody or antigen-binding fragment of any of embodiments 1-38, provided that the LCDR1 comprises SEQ ID NO: 10018.
40. The antibody or antigen-binding fragment of any of embodiments 1-38, provided that the LCDR1 comprises an amino acid sequence that differs from SEQ ID NO: 10018 by up to five, four, three, or two amino acids.
41. The antibody or antigen-binding fragment of any of embodiments 1-40, provided that the LCDR2 comprises SEQ ID NO: 10021.
42. The antibody or antigen-binding fragment of any of embodiments 1-40, provided that the LCDR2 comprises an amino acid sequence that differs from SEQ ID NO: 10021 by up to five, four, three, or two amino acids.
43. The antibody or antigen-binding fragment of any of embodiments 1-42, provided that the LCDR3 comprises SEQ ID NO: 10024.
44. The antibody or antigen-binding fragment of any of embodiments 1-42, provided that the LCDR3 comprises SEQ ID NO: 100155.
45. The antibody or antigen-binding fragment of embodiment 44, provided that $X_1$ is N.
46. The antibody or antigen-binding fragment of embodiment 44 or embodiment 45, provided that $X_2$ is selected from D, E, H, N, and Q.
47. The antibody or antigen-binding fragment of any of embodiments 44-46, provided that $X_3$ is A.
48. The antibody or antigen-binding fragment of any of embodiments 44-47, provided that $X_4$ is selected from D, F, K, R, S, and T.
49. The antibody or antigen-binding fragment of any of embodiments 1-42, provided that the LCDR3 comprises an amino acid sequence selected from SEQ ID NOS: 100315-100482.
50. The antibody or antigen-binding fragment of embodiment 1, provided that the HFR1 comprises SEQ ID NO: 100100, the HFR2 comprises SEQ ID NO: 100101, the HFR3 comprises SEQ ID NO: 100102, the HFR4 comprises SEQ ID NO: 100103, the LFRI comprises SEQ ID NO: 100104, the LFR2 comprises SEQ ID NO: 100105, the LFR3 comprises SEQ ID NO: 100106, and the LFR4 comprises SEQ ID NO: 100107.
51. The antibody or antigen-binding fragment of embodiment 1, provided that the HFR1 comprises SEQ ID NO: 100108, the HFR2 comprises SEQ ID NO: 100101, the HFR3 comprises SEQ ID NO: 100109, the HFR4 comprises SEQ ID NO: 100103, the LFRI comprises SEQ ID NO: 100104, the LFR2 comprises SEQ ID NO: 100105, the LFR3 comprises SEQ ID NO: 100110, and the LFR4 comprises SEQ ID NO: 100107.
52. The antibody or antigen-binding fragment of embodiment 1, provided that the HFR1 comprises SEQ ID NO: 100108, the HFR2 comprises SEQ ID NO: 100101, the HFR3 comprises SEQ ID NO: 100109, the HFR4 comprises SEQ ID NO: 100103, the LFRI comprises SEQ ID NO: 100104, the LFR2 comprises SEQ ID NO: 100105, the LFR3 comprises SEQ ID NO: 100106, and the LFR4 comprises SEQ ID NO: 100107.

53. The antibody or antigen-binding fragment of any of embodiments 1 and 50-52, provided that the HCDR1 comprises SEQ ID NO: 1009, the HCDR2 comprises SEQ ID NO: 10012, the HCDR3 comprises SEQ ID NO: 10015, the LCDR1 comprises SEQ ID NO: 10018, the LCDR2 comprises SEQ ID NO: 10021, and the LCDR3 comprises SEQ ID NO: 10024.

54. The antibody or antigen-binding fragment of any of embodiments 1 and 50-52, provided that the HCDR1 comprises SEQ ID NO: 100150, the HCDR2 comprises SEQ ID NO: 10012, the HCDR3 comprises SEQ ID NO: 100152, the LCDR1 comprises SEQ ID NO: 10018, the LCDR2 comprises SEQ ID NO: 10021, and the LCDR3 comprises SEQ ID NO: 100155.

55. The antibody or antigen-binding fragment of embodiment 1, provided that the HFR1 comprises SEQ ID NO: 100100, the HFR2 comprises SEQ ID NO: 100101, the HFR3 comprises SEQ ID NO: 100102, the HFR4 comprises SEQ ID NO: 100103, the LFRI comprises SEQ ID NO: 100104, the LFR2 comprises SEQ ID NO: 100105, the LFR3 comprises SEQ ID NO: 100106, the LFR4 comprises SEQ ID NO: 100107, the HCDR1 comprises SEQ ID NO: 1009, the HCDR2 comprises SEQ ID NO: 10012, the HCDR3 comprises SEQ ID NO: 10015, the LCDR1 comprises SEQ ID NO: 10018, the LCDR2 comprises SEQ ID NO: 10021, and the LCDR3 comprises SEQ ID NO: 10024.

56. The antibody or antigen-binding fragment of embodiment 1, provided that the HFR1 comprises SEQ ID NO: 100100, the HFR2 comprises SEQ ID NO: 100101, the HFR3 comprises SEQ ID NO: 100102, the HFR4 comprises SEQ ID NO: 100103, the LFRI comprises SEQ ID NO: 100104, the LFR2 comprises SEQ ID NO: 100105, the LFR3 comprises SEQ ID NO: 100106, the LFR4 comprises SEQ ID NO: 100107, the HCDR1 comprises SEQ ID NO: 100150, the HCDR2 comprises SEQ ID NO: 10012, the HCDR3 comprises SEQ ID NO: 100152, the LCDR1 comprises SEQ ID NO: 10018, the LCDR2 comprises SEQ ID NO: 10021, and the LCDR3 comprises SEQ ID NO: 100155.

57. The antibody or antigen-binding fragment of embodiment 1, provided that the HFR1 comprises SEQ ID NO: 100108, the HFR2 comprises SEQ ID NO: 100101, the HFR3 comprises SEQ ID NO: 100109, the HFR4 comprises SEQ ID NO: 100103, the LFRI comprises SEQ ID NO: 100104, the LFR2 comprises SEQ ID NO: 100105, the LFR3 comprises SEQ ID NO: 100110, the LFR4 comprises SEQ ID NO: 100107, the HCDR1 comprises SEQ ID NO: 1009, the HCDR2 comprises SEQ ID NO: 10012, the HCDR3 comprises SEQ ID NO: 10015, the LCDR1 comprises SEQ ID NO: 10018, the LCDR2 comprises SEQ ID NO: 10021, and the LCDR3 comprises SEQ ID NO: 10024.

58. The antibody or antigen-binding fragment of embodiment 1, provided that the HFR1 comprises SEQ ID NO: 100108, the HFR2 comprises SEQ ID NO: 100101, the HFR3 comprises SEQ ID NO: 100109, the HFR4 comprises SEQ ID NO: 100103, the LFRI comprises SEQ ID NO: 100104, the LFR2 comprises SEQ ID NO: 100105, the LFR3 comprises SEQ ID NO: 100110, the LFR4 comprises SEQ ID NO: 100107, the HCDR1 comprises SEQ ID NO: 100150, the HCDR2 comprises SEQ ID NO: 10012, the HCDR3 comprises SEQ ID NO: 100152, the LCDR1 comprises SEQ ID NO: 10018, the LCDR2 comprises SEQ ID NO: 10021, and the LCDR3 comprises SEQ ID NO: 100155.

59. The antibody or antigen-binding fragment of embodiment 1, provided that the HFR1 comprises SEQ ID NO: 100108, the HFR2 comprises SEQ ID NO: 100101, the HFR3 comprises SEQ ID NO: 100109, the HFR4 comprises SEQ ID NO: 100103, the LFRI comprises SEQ ID NO: 100104, the LFR2 comprises SEQ ID NO: 100105, the LFR3 comprises SEQ ID NO: 100106, the LFR4 comprises SEQ ID NO: 100107, the HCDR1 comprises SEQ ID NO: 1009, the HCDR2 comprises SEQ ID NO: 10012, the HCDR3 comprises SEQ ID NO: 10015, the LCDR1 comprises SEQ ID NO: 10018, the LCDR2 comprises SEQ ID NO: 10021, and the LCDR3 comprises SEQ ID NO: 10024.

60. The antibody or antigen-binding fragment of embodiment 1, provided that the HFR1 comprises SEQ ID NO: 100108, the HFR2 comprises SEQ ID NO: 100101, the HFR3 comprises SEQ ID NO: 100109, the HFR4 comprises SEQ ID NO: 100103, the LFRI comprises SEQ ID NO: 100104, the LFR2 comprises SEQ ID NO: 100105, the LFR3 comprises SEQ ID NO: 100106, the LFR4 comprises SEQ ID NO: 100107, the HCDR1 comprises SEQ ID NO: 100150, the HCDR2 comprises SEQ ID NO: 10012, the HCDR3 comprises SEQ ID NO: 100152, the LCDR1 comprises SEQ ID NO: 10018, the LCDR2 comprises SEQ ID NO: 10021, and the LCDR3 comprises SEQ ID NO: 100155.

61. The antibody or antigen-binding fragment of any of embodiments 1, 54, 56, 58, and 60, provided that the $X_1$ of SEQ ID NO: 100150 is D.

62. The antibody or antigen-binding fragment of any of embodiments 1, 54, 56, 58, and 60, provided that the $X_1$ of SEQ ID NO: 100150 is E.

63. The antibody or antigen-binding fragment of any of embodiments 1, 54, 56, 58, and 60-62, provided that the $X_2$ of SEQ ID NO: 100150 is I.

64. The antibody or antigen-binding fragment of any of embodiments 1, 54, 56, 58, and 60-62, provided that the $X_2$ of SEQ ID NO: 100150 is P.

65. The antibody or antigen-binding fragment of any of embodiments 1, 54, 56, 58, and 60-62, provided that the $X_2$ of SEQ ID NO: 100150 is V.

66. The antibody or antigen-binding fragment of any of embodiments 1, 54, 56, 58, and 60-65, provided that the $X_3$ of SEQ ID NO: 100150 is G.

67. The antibody or antigen-binding fragment of any of embodiments 1, 54, 56, 58, and 60-65, provided that the $X_3$ of SEQ ID NO: 100150 is Q.

68. The antibody or antigen-binding fragment of any of embodiments 1, 54, 56, 58, and 60-65, provided that the $X_3$ of SEQ ID NO: 100150 is S.

69. The antibody or antigen-binding fragment of any of embodiments 1, 54, 56, 58, and 60-65, provided that the $X_3$ of SEQ ID NO: 100150 is V.

70. The antibody or antigen-binding fragment of any of embodiments 1, 54, 56, 58, and 60-69, provided that the $X_4$ of SEQ ID NO: 100150 is F.

71. The antibody or antigen-binding fragment of any of embodiments 1, 54, 56, 58, and 60-69, provided that the $X_4$ of SEQ ID NO: 100150 is Y.

72. The antibody or antigen-binding fragment of any of embodiments 1, 54, 56, 58, and 60-71, provided that the $X_5$ of SEQ ID NO: 100150 is I.

73. The antibody or antigen-binding fragment of any of embodiments 1, 54, 56, 58, and 60-71, provided that the $X_5$ of SEQ ID NO: 100150 is M.

74. The antibody or antigen-binding fragment of any of embodiments 1, 54, 56, 58, and 60-73, provided that the $X_1$ of SEQ ID NO: 100152 is L.
75. The antibody or antigen-binding fragment of any of embodiments 1, 54, 56, 58, and 60-73, provided that the $X_1$ of SEQ ID NO: 100152 is M.
76. The antibody or antigen-binding fragment of any of embodiments 1, 54, 56, 58, and 60-75, provided that the $X_2$ of SEQ ID NO: 100152 is E.
77. The antibody or antigen-binding fragment of any of embodiments 1, 54, 56, 58, and 60-75, provided that the $X_2$ of SEQ ID NO: 100152 is I.
78. The antibody or antigen-binding fragment of any of embodiments 1, 54, 56, 58, and 60-75, provided that the $X_2$ of SEQ ID NO: 100152 is K.
79. The antibody or antigen-binding fragment of any of embodiments 1, 54, 56, 58, and 60-75, provided that the $X_2$ of SEQ ID NO: 100152 is L.
80. The antibody or antigen-binding fragment of any of embodiments 1, 54, 56, 58, and 60-75, provided that the $X_2$ of SEQ ID NO: 100152 is M.
81. The antibody or antigen-binding fragment of any of embodiments 1, 54, 56, 58, and 60-75, provided that the $X_2$ of SEQ ID NO: 100152 is Q.
82. The antibody or antigen-binding fragment of any of embodiments 1, 54, 56, 58, and 60-75, provided that the $X_2$ of SEQ ID NO: 100152 is T.
83. The antibody or antigen-binding fragment of any of embodiments 1, 54, 56, 58, and 60-75, provided that the $X_2$ of SEQ ID NO: 100152 is V.
84. The antibody or antigen-binding fragment of any of embodiments 1, 54, 56, 58, and 60-75, provided that the $X_2$ of SEQ ID NO: 100152 is W.
85. The antibody or antigen-binding fragment of any of embodiments 1, 54, 56, 58, and 60-75, provided that the $X_2$ of SEQ ID NO: 100152 is Y.
86. The antibody or antigen-binding fragment of any of embodiments 1, 54, 56, 58, and 60-85, provided that the $X_1$ of SEQ ID NO: 100155 is Q.
87. The antibody or antigen-binding fragment of any of embodiments 1, 54, 56, 58, and 60-85, provided that the $X_1$ of SEQ ID NO: 100155 is N.
88. The antibody or antigen-binding fragment of any of embodiments 1, 54, 56, 58, and 60-87, provided that the $X_2$ of SEQ ID NO: 100155 is D.
89. The antibody or antigen-binding fragment of any of embodiments 1, 54, 56, 58, and 60-87, provided that the $X_2$ of SEQ ID NO: 100155 is E.
90. The antibody or antigen-binding fragment of any of embodiments 1, 54, 56, 58, and 60-87, provided that the $X_2$ of SEQ ID NO: 100155 is H.
91. The antibody or antigen-binding fragment of any of embodiments 1, 54, 56, 58, and 60-87, provided that the $X_2$ of SEQ ID NO: 100155 is N.
92. The antibody or antigen-binding fragment of any of embodiments 1, 54, 56, 58, and 60-87, provided that the $X_2$ of SEQ ID NO: 100155 is Q.
93. The antibody or antigen-binding fragment of any of embodiments 1, 54, 56, 58, and 60-87, provided that the $X_2$ of SEQ ID NO: 100155 is S.
94. The antibody or antigen-binding fragment of any of embodiments 1, 54, 56, 58, and 60-93, provided that the $X_3$ of SEQ ID NO: 100155 is A.
95. The antibody or antigen-binding fragment of any of embodiments 1, 54, 56, 58, and 60-93, provided that the $X_3$ of SEQ ID NO: 100155 is G.
96. The antibody or antigen-binding fragment of any of embodiments 1, 54, 56, 58, and 60-95, provided that the $X_4$ of SEQ ID NO: 100155 is D.
97. The antibody or antigen-binding fragment of any of embodiments 1, 54, 56, 58, and 60-95, provided that the $X_4$ of SEQ ID NO: 100155 is F.
98. The antibody or antigen-binding fragment of any of embodiments 1, 54, 56, 58, and 60-95, provided that the $X_4$ of SEQ ID NO: 100155 is K.
99. The antibody or antigen-binding fragment of any of embodiments 1, 54, 56, 58, and 60-95, provided that the $X_4$ of SEQ ID NO: 100155 is N.
100. The antibody or antigen-binding fragment of any of embodiments 1, 54, 56, 58, and 60-95, provided that the $X_4$ of SEQ ID NO: 100155 is R.
101. The antibody or antigen-binding fragment of any of embodiments 1, 54, 56, 58, and 60-95, provided that the $X_4$ of SEQ ID NO: 100155 is S.
102. The antibody or antigen-binding fragment of any of embodiments 1, 54, 56, 58, and 60-95, provided that the $X_4$ of SEQ ID NO: 100155 is T.
103. The antibody or antigen-binding fragment of any of embodiments 1-102, provided that the antibody or antigen-binding fragment specifically binds to human TL1A.
104. The antibody or antigen-binding fragment of embodiment 103, provided that the antibody or antigen-binding fragment specifically binds to human TL1A with a $K_d$ of $1\times10^{-9}$ M or less.
105. The antibody or antigen-binding fragment of embodiment 104, provided that the $K_d$ is measured using a method selected from a standard ELISA assay and SPR.
106. The antibody or antigen-binding fragment of any of embodiments 1-105, provided that the antibody or antigen-binding fragment inhibits binding of DR3 to human TL1A.
107. The antibody or antigen-binding fragment of any of embodiments 1-106, provided that the antibody or antigen-binding fragment inhibits binding of DcR3 to human TL1A.
108. The antibody or antigen-binding fragment of any of embodiments 1-107, provided that the antibody or antigen-binding fragment is a humanized antibody, a CDR-grafted antibody, a chimeric antibody, a Fab, a ScFv, or a combination thereof
109. The antibody or antigen-binding fragment of any of embodiments 1-108, comprising a human CH1 domain.
110. The antibody or antigen-binding fragment of any of embodiments 1-109, comprising a human CH2 domain.
111. The antibody or antigen-binding fragment of embodiment 110, provided that that CH2 domain comprises at least one mutation selected from L234A, L235A, and G237A, as numbered using Kabat.
112. The antibody or antigen-binding fragment of any of embodiments 1-111, comprising a human CH3 domain.
113. A pharmaceutical composition comprising a therapeutically effective amount of the antibody or antigen-binding fragment of any of embodiments 1-112, and a pharmaceutically acceptable carrier.
114. A method of treating an inflammatory disease in a subject in need thereof, comprising administering to the subject a therapeutically effective amount of the antibody or antigen-binding fragment of any of embodiments 1-113.
115. The method of embodiment 114, provided that the inflammatory disease is inflammatory bowel disease.
116. The method of embodiment 115, provided that the inflammatory bowel disease comprises Crohn's disease.

117. The method of embodiment 116, provided that the subject has been determined to be non-responsive to anti-TNF alpha therapy.

118. The method of embodiment 116 or embodiment 117, provided that the subject has been determined to comprise a disease phenotype comprising non-stricturing/non-penetrating, stricturing, stricturing and penetrating, or isolated internal penetrating.

119. An antibody or antigen-binding fragment that specifically binds to TL1A, comprising:
a heavy chain variable region comprising four heavy chain framework regions (HFR1, HFR2, HFR3, and HFR4) comprising SEQ ID NOS: 100100-100103, and three heavy chain complementarity-determining regions (HCDR1, HCDR2, and HCDR3) comprising:
   (a) a HCDR1 selected from: (i) a HCDR1 comprising SEQ ID NO: 1009, (ii) a HCDR1 comprising SEQ ID NO: 100150, wherein $X_1$ is selected from D and E, $X_2$ is selected from I, P and V, $X_3$ is selected from G, Q, S, and V, $X_4$ is selected from F and Y, and $X_5$ is selected from I and M, (iii) a HCDR1 selected from SEQ ID NOS: 100200-100295, and (iv) a HCDR1 comprising an amino acid sequence that differs from a sequence selected from the group consisting of SEQ ID NOS: 1009, 100150 and 100200-100295 by up to five, four, three, or two amino acids,
   (b) a HCDR2 selected from: (i) a HCDR2 comprising SEQ ID NO: 10012, and (ii) a HCDR2 comprising an amino acid sequence that differs from SEQ ID NO: 10012 by up to five, four, three, or two amino acids, and
   (c) a HCDR3 selected from (i) a HCDR3 comprising SEQ ID NO: 10015, (ii) a HCDR3 comprising SEQ ID NO: 100152, wherein $X_1$ is selected from L and M, and $X_2$ is selected from E, I, K, L, M, Q, T, V, W, and Y, (iii) a HCDR3 selected from SEQ ID NOS: 100296-100314, and (iv) a HCDR3 comprising an amino acid sequence that differs from a sequence selected from the group consisting of SEQ ID NOS: 10015, 100152 and 100296-100314 by up to five, four, three, or two amino acids; and
a light chain variable region comprising four light chain framework regions (LFR1, LFR2, LFR3, and LFR4) comprising SEQ ID NOS: 100104-100107, and three light chain complementarity-determining regions (LCDR1, LCDR2, and LCDR3) comprising:
   (a) a LCDR1 selected from: (i) a LCDR1 comprising SEQ ID NO: 10018, and (ii) a LCDR1 comprising an amino acid sequence that differs from SEQ ID NO: 10018 by up to five, four, three, or two amino acids,
   (b) a LCDR2 selected from: (i) a LCDR2 comprising SEQ ID NO: 10021, and (ii) a LCDR2 comprising an amino acid sequence that differs from SEQ ID NO: 10021 by up to five, four, three, or two amino acids, and
   (c) a LCDR3 selected from (i) a LCDR3 comprising SEQ ID NO: 10024, (ii) a LCDR3 comprising SEQ ID NO: 100155, wherein $X_1$ is selected from Q and N, $X_2$ is selected from D, E, H, N, Q, and S, $X_3$ is selected from A and G, and $X_4$ is selected from D, F, K, N, R, S, and T, (iii) a LCDR3 selected from SEQ ID NOS: 100315-100482, and (iv) a LCDR3 comprising an amino acid sequence that differs from a sequence selected from the group consisting of SEQ ID NOS: 10024, 100155, and 100315-100482 by up to five, four, three, or two amino acids.

120. The antibody or antigen-binding fragment of embodiment 119, provided that the HCDR1 comprises SEQ ID NO: 1009.

121. The antibody or antigen-binding fragment of embodiment 119, provided that the HCDR1 comprises SEQ ID NO: 100150.

122. The antibody or antigen-binding fragment of embodiment 121, provided that $X_1$ is E.

123. The antibody or antigen-binding fragment of embodiment 121 or embodiment 122, provided that $X_2$ is selected from P and V.

124. The antibody or antigen-binding fragment of any of embodiments 121-123, provided that $X_3$ is selected from G, S, and V.

125. The antibody or antigen-binding fragment of any of embodiments 121-124, provided that $X_4$ is F.

126. The antibody or antigen-binding fragment of any of embodiments 121-125, provided that $X_5$ is I.

127. The antibody or antigen-binding fragment of embodiment 119, provided that the HCDR1 comprises an amino acid sequence selected from SEQ ID NOS: 100200-100295.

128. The antibody or antigen-binding fragment of any of embodiments 119-127, provided that the HCDR2 comprises SEQ ID NO: 10012.

129. The antibody or antigen-binding fragment of any of embodiments 119-127, provided that the HCDR2 comprises an amino acid sequence that differs from SEQ ID NO: 10012 by up to five, four, three, or two amino acids.

130. The antibody or antigen-binding fragment of any of embodiments 119-129, provided that the HCDR3 comprises SEQ ID NO: 10015.

131. The antibody or antigen-binding fragment of any of embodiments 119-129, provided that the HCDR3 comprises SEQ ID NO: 100152.

132. The antibody or antigen-binding fragment of embodiment 131, provided that $X_1$ is M.

133. The antibody or antigen-binding fragment of embodiment 131 or embodiment 132, provided that $X_2$ is selected from E, I, K, L, M, Q, T, W, and Y.

134. The antibody or antigen-binding fragment of any of embodiments 119-129, provided that the HCDR3 comprises a sequence selected from SEQ ID NOS: 100296-100314.

135. The antibody or antigen-binding fragment of any of embodiments 119-134, provided that the LCDR1 comprises SEQ ID NO: 10018.

136. The antibody or antigen-binding fragment of any of embodiments 119-134, provided that the LCDR1 comprises an amino acid sequence that differs from SEQ ID NO: 10018 by up to five, four, three, or two amino acids.

137. The antibody or antigen-binding fragment of any of embodiments 119-136, provided that the LCDR2 comprises SEQ ID NO: 10021.

138. The antibody or antigen-binding fragment of any of embodiments 119-136, provided that the LCDR2 comprises an amino acid sequence that differs from SEQ ID NO: 10021 by up to five, four, three, or two amino acids.

139. The antibody or antigen-binding fragment of any of embodiments 119-138, provided that the LCDR3 comprises SEQ ID NO: 10024.

140. The antibody or antigen-binding fragment of any of embodiments 119-138, provided that the LCDR3 comprises SEQ ID NO: 100155.

141. The antibody or antigen-binding fragment of embodiment 140, provided that $X_1$ is N.

142. The antibody or antigen-binding fragment of embodiment 140 or embodiment 141, provided that $X_2$ is selected from D, E, H, N, and Q.
143. The antibody or antigen-binding fragment of any of embodiments 140-142, provided that $X_3$ is A.
144. The antibody or antigen-binding fragment of any of embodiments 140-143, provided that $X_4$ is selected from D, F, K, R, S, and T.
145. The antibody or antigen-binding fragment of any of embodiments 119-138, provided that the LCDR3 comprises an amino acid sequence selected from SEQ ID NOS: 100315-100482.
146. The antibody or antigen-binding fragment of embodiment 119, provided that the HCDR1 comprises SEQ ID NO: 1009, the HCDR2 comprises SEQ ID NO: 10012, the HCDR3 comprises SEQ ID NO: 10015, the LCDR1 comprises SEQ ID NO: 10018, the LCDR2 comprises SEQ ID NO: 10021, and the LCDR3 comprises SEQ ID NO: 10024.
147. The antibody or antigen-binding fragment of embodiment 119, provided that the HCDR1 comprises SEQ ID NO: 100150, the HCDR2 comprises SEQ ID NO: 10012, the HCDR3 comprises SEQ ID NO: 100152, the LCDR1 comprises SEQ ID NO: 10018, the LCDR2 comprises SEQ ID NO: 10021, and the LCDR3 comprises SEQ ID NO: 100155.
148. The antibody or antigen-binding fragment of embodiment 119 or embodiment 147, provided that the $X_1$ of SEQ ID NO: 100150 is D.
149. The antibody or antigen-binding fragment of embodiment 119 or embodiment 147 provided that the $X_1$ of SEQ ID NO: 100150 is E.
150. The antibody or antigen-binding fragment of any of embodiments 119, 147-149, provided that the $X_2$ of SEQ ID NO: 100150 is I.
151. The antibody or antigen-binding fragment of any of embodiments 119, 147-149, provided that the $X_2$ of SEQ ID NO: 100150 is P.
152. The antibody or antigen-binding fragment of any of embodiments 119, 147-149, provided that the $X_2$ of SEQ ID NO: 100150 is V.
153. The antibody or antigen-binding fragment of any of embodiments 119, 147-152, provided that the $X_3$ of SEQ ID NO: 100150 is G.
154. The antibody or antigen-binding fragment of any of embodiments 119, 147-152, provided that the $X_3$ of SEQ ID NO: 100150 is Q.
155. The antibody or antigen-binding fragment of any of embodiments 119, 147-152, provided that the $X_3$ of SEQ ID NO: 100150 is S.
156. The antibody or antigen-binding fragment of any of embodiments 119, 147-152, provided that the $X_3$ of SEQ ID NO: 100150 is V.
157. The antibody or antigen-binding fragment of any of embodiments 119, 147-156, provided that the $X_4$ of SEQ ID NO: 100150 is F.
158. The antibody or antigen-binding fragment of any of embodiments 119, 147-156, provided that the $X_4$ of SEQ ID NO: 100150 is Y.
159. The antibody or antigen-binding fragment of any of embodiments 119, 147-158, provided that the $X_5$ of SEQ ID NO: 100150 is I.
160. The antibody or antigen-binding fragment of any of embodiments 119, 147-158, provided that the $X_5$ of SEQ ID NO: 100150 is M.
161. The antibody or antigen-binding fragment of any of embodiments 119, 147-160, provided that the $X_1$ of SEQ ID NO: 100152 is L.
162. The antibody or antigen-binding fragment of any of embodiments 119, 147-160, provided that the $X_1$ of SEQ ID NO: 100152 is M.
163. The antibody or antigen-binding fragment of any of embodiments 119, 147-162, provided that the $X_2$ of SEQ ID NO: 100152 is E.
164. The antibody or antigen-binding fragment of any of embodiments 119, 147-162, provided that the $X_2$ of SEQ ID NO: 100152 is I.
165. The antibody or antigen-binding fragment of any of embodiments 119, 147-162, provided that the $X_2$ of SEQ ID NO: 100152 is K.
166. The antibody or antigen-binding fragment of any of embodiments 119, 147-162, provided that the $X_2$ of SEQ ID NO: 100152 is L.
167. The antibody or antigen-binding fragment of any of embodiments 119, 147-162, provided that the $X_2$ of SEQ ID NO: 100152 is M.
168. The antibody or antigen-binding fragment of any of embodiments 119, 147-162, provided that the $X_2$ of SEQ ID NO: 100152 is Q.
169. The antibody or antigen-binding fragment of any of embodiments 119, 147-162, provided that the $X_2$ of SEQ ID NO: 100152 is T.
170. The antibody or antigen-binding fragment of any of embodiments 119, 147-162, provided that the $X_2$ of SEQ ID NO: 100152 is V.
171. The antibody or antigen-binding fragment of any of embodiments 119, 147-162, provided that the $X_2$ of SEQ ID NO: 100152 is W.
172. The antibody or antigen-binding fragment of any of embodiments 119, 147-162, provided that the $X_2$ of SEQ ID NO: 100152 is Y.
173. The antibody or antigen-binding fragment of any of embodiments 119, 147-172, provided that the $X_1$ of SEQ ID NO: 100155 is Q.
174. The antibody or antigen-binding fragment of any of embodiments 119, 147-172, provided that the $X_1$ of SEQ ID NO: 100155 is N.
175. The antibody or antigen-binding fragment of any of embodiments 119, 147-174, provided that the $X_2$ of SEQ ID NO: 100155 is D.
176. The antibody or antigen-binding fragment of any of embodiments 119, 147-174, provided that the $X_2$ of SEQ ID NO: 100155 is E.
177. The antibody or antigen-binding fragment of any of embodiments 119, 147-174, provided that the $X_2$ of SEQ ID NO: 100155 is H.
178. The antibody or antigen-binding fragment of any of embodiments 119, 147-174, provided that the $X_2$ of SEQ ID NO: 100155 is N.
179. The antibody or antigen-binding fragment of any of embodiments 119, 147-174, provided that the $X_2$ of SEQ ID NO: 100155 is Q.
180. The antibody or antigen-binding fragment of any of embodiments 119, 147-174, provided that the $X_2$ of SEQ ID NO: 100155 is S.
181. The antibody or antigen-binding fragment of any of embodiments 119, 147-180, provided that the $X_3$ of SEQ ID NO: 100155 is A.
182. The antibody or antigen-binding fragment of any of embodiments 119, 147-180, provided that the $X_3$ of SEQ ID NO: 100155 is G.

183. The antibody or antigen-binding fragment of any of embodiments 119, 147-182, provided that the $X_4$ of SEQ ID NO: 100155 is D.
184. The antibody or antigen-binding fragment of any of embodiments 119, 147-182, provided that the $X_4$ of SEQ ID NO: 100155 is F.
185. The antibody or antigen-binding fragment of any of embodiments 119, 147-182, provided that the $X_4$ of SEQ ID NO: 100155 is K.
186. The antibody or antigen-binding fragment of any of embodiments 119, 147-182, provided that the $X_4$ of SEQ ID NO: 100155 is N.
187. The antibody or antigen-binding fragment of any of embodiments 119, 147-182, provided that the $X_4$ of SEQ ID NO: 100155 is R.
188. The antibody or antigen-binding fragment of any of embodiments 119, 147-182, provided that the $X_4$ of SEQ ID NO: 100155 is S.
189. The antibody or antigen-binding fragment of any of embodiments 119, 147-182, provided that the $X_4$ of SEQ ID NO: 100155 is T.
190. The antibody or antigen-binding fragment of any of embodiments 119-189, provided that the antibody or antigen-binding fragment specifically binds to human TL1A.
191. The antibody or antigen-binding fragment of embodiment 190, provided that the antibody or antigen-binding fragment specifically binds to human TL1A with a $K_d$ of $1 \times 10^{-9}$ M or less.
192. The antibody or antigen-binding fragment of embodiment 191, provided that the $K_d$ is measured using a method selected from a standard ELISA assay and SPR.
193. The antibody or antigen-binding fragment of any of embodiments 119-192, provided that the antibody or antigen-binding fragment inhibits binding of DR3 to human TL1A.
194. The antibody or antigen-binding fragment of any of embodiments 119-193, provided that the antibody or antigen-binding fragment inhibits binding of DcR3 to human TL1A.
195. The antibody or antigen-binding fragment of any of embodiments 119-194, provided that the antibody or antigen-binding fragment is a humanized antibody, a CDR-grafted antibody, a chimeric antibody, a Fab, a ScFv, or a combination thereof
196. The antibody or antigen-binding fragment of any of embodiments 119-195, comprising a human CH1 domain.
197. The antibody or antigen-binding fragment of any of embodiments 119-196, comprising a human CH2 domain.
198. The antibody or antigen-binding fragment of embodiment 197, provided that that CH2 domain comprises at least one mutation selected from L234A, L235A, and G237A, as numbered using Kabat.
199. The antibody or antigen-binding fragment of any of embodiments 119-198, comprising a human CH3 domain.
200. A pharmaceutical composition comprising a therapeutically effective amount of the antibody or antigen-binding fragment of any of embodiments 119-199, and a pharmaceutically acceptable carrier.
201. A method of treating an inflammatory disease in a subject in need thereof, comprising administering to the subject a therapeutically effective amount of the antibody or antigen-binding fragment of any of embodiments 119-199.
202. The method of embodiment 201, provided that the inflammatory disease is inflammatory bowel disease.
203. The method of embodiment 202, provided that the inflammatory bowel disease comprises Crohn's disease.
204. The method of embodiment 203, provided that the subject has been determined to be non-responsive to anti-TNF alpha therapy.
205. The method of embodiment 203 or embodiment 204, provided that the subject has been determined to comprise a disease phenotype comprising non-stricturing/non-penetrating, stricturing, stricturing and penetrating, or isolated internal penetrating.
206. An antibody or antigen-binding fragment that specifically binds to TL1A, comprising:
a heavy chain variable region comprising four heavy chain framework regions (HFR1, HFR2, HFR3, and HFR4) comprising SEQ ID NOS: 100108, 100101, 100109, and 100103, respectively, and three heavy chain complementarity-determining regions (HCDR1, HCDR2, and HCDR3) comprising:
(a) a HCDR1 selected from: (i) a HCDR1 comprising SEQ ID NO: 1009, (ii) a HCDR1 comprising SEQ ID NO: 100150, wherein $X_1$ is selected from D and E, $X_2$ is selected from I, P and V, $X_3$ is selected from G, Q, S, and V, $X_4$ is selected from F and Y, and $X_5$ is selected from I and M, (iii) a HCDR1 selected from SEQ ID NOS: 100200-100295, and (iv) a HCDR1 comprising an amino acid sequence that differs from a sequence selected from the group consisting of SEQ ID NOS: 1009, 100150 and 100200-100295 by up to five, four, three, or two amino acids,
(b) a HCDR2 selected from: (i) a HCDR2 comprising SEQ ID NO: 10012, and (ii) a HCDR2 comprising an amino acid sequence that differs from SEQ ID NO: 10012 by up to five, four, three, or two amino acids, and
(c) a HCDR3 selected from (i) a HCDR3 comprising SEQ ID NO: 10015, (ii) a HCDR3 comprising SEQ ID NO: 100152, wherein $X_1$ is selected from L and M, and $X_2$ is selected from E, I, K, L, M, Q, T, V, W, and Y, (iii) a HCDR3 selected from SEQ ID NOS: 100296-100314, and (iv) a HCDR3 comprising an amino acid sequence that differs from a sequence selected from the group consisting of SEQ ID NOS: 10015, 100152 and 100296-100314 by up to five, four, three, or two amino acids; and
a light chain variable region comprising four light chain framework regions (LFR1, LFR2, LFR3, and LFR4) comprising SEQ ID NOS: 100104, 100105, 100110, and 100107, respectively, and three light chain complementarity-determining regions (LCDR1, LCDR2, and LCDR3) comprising:
(a) a LCDR1 selected from: (i) a LCDR1 comprising SEQ ID NO: 10018, and (ii) a LCDR1 comprising an amino acid sequence that differs from SEQ ID NO: 10018 by up to five, four, three, or two amino acids,
(b) a LCDR2 selected from: (i) a LCDR2 comprising SEQ ID NO: 10021, and (ii) a LCDR2 comprising an amino acid sequence that differs from SEQ ID NO: 10021 by up to five, four, three, or two amino acids, and
(c) a LCDR3 selected from (i) a LCDR3 comprising SEQ ID NO: 10024, (ii) a LCDR3 comprising SEQ ID NO: 100155, wherein $X_1$ is selected from Q and N, $X_2$ is selected from D, E, H, N, Q, and S, $X_3$ is selected from A and G, and $X_4$ is selected from D, F, K, N, R, S, and T, (iii) a LCDR3 selected from SEQ ID NOS: 100315-100482, and (iv) a LCDR3 comprising an amino acid sequence that differs from a sequence selected from the group consisting of SEQ ID NOS: 10024, 100155, and 100315-100482 by up to five, four, three, or two amino acids.
207. The antibody or antigen-binding fragment of embodiment 206, provided that the HCDR1 comprises SEQ ID NO: 1009.
208. The antibody or antigen-binding fragment of embodiment 206, provided that the HCDR1 comprises SEQ ID NO: 100150.
209. The antibody or antigen-binding fragment of embodiment 208, provided that $X_1$ is E.
210. The antibody or antigen-binding fragment of embodiment 208 or embodiment 209, provided that $X_2$ is selected from P and V.
211. The antibody or antigen-binding fragment of any of embodiments 208-210, provided that $X_3$ is selected from G, S, and V.
212. The antibody or antigen-binding fragment of any of embodiments 208-211, provided that $X_4$ is F.
213. The antibody or antigen-binding fragment of any of embodiments 208-212, provided that $X_5$ is I.
214. The antibody or antigen-binding fragment of embodiment 206, provided that the HCDR1 comprises an amino acid sequence selected from SEQ ID NOS: 100200-100295.
215. The antibody or antigen-binding fragment of any of embodiments 206-214, provided that the HCDR2 comprises SEQ ID NO: 10012.
216. The antibody or antigen-binding fragment of any of embodiments 206-214, provided that the HCDR2 comprises an amino acid sequence that differs from SEQ ID NO: 10012 by up to five, four, three, or two amino acids.
217. The antibody or antigen-binding fragment of any of embodiments 206-216, provided that the HCDR3 comprises SEQ ID NO: 10015.
218. The antibody or antigen-binding fragment of any of embodiments 206-216, provided that the HCDR3 comprises SEQ ID NO: 100152.
219. The antibody or antigen-binding fragment of embodiment 218, provided that $X_1$ is M.
220. The antibody or antigen-binding fragment of embodiment 218 or embodiment 219, provided that $X_2$ is selected from E, I, K, L, M, Q, T, W, and Y.
221. The antibody or antigen-binding fragment of any of embodiments 206-220, provided that the HCDR3 comprises a sequence selected from SEQ ID NOS: 100296-100314.
222. The antibody or antigen-binding fragment of any of embodiments 206-221, provided that the LCDR1 comprises SEQ ID NO: 10018.
223. The antibody or antigen-binding fragment of any of embodiments 206-221, provided that the LCDR1 comprises an amino acid sequence that differs from SEQ ID NO: 10018 by up to five, four, three, or two amino acids.
224. The antibody or antigen-binding fragment of any of embodiments 206-223, provided that the LCDR2 comprises SEQ ID NO: 10021.
225. The antibody or antigen-binding fragment of any of embodiments 206-223, provided that the LCDR2 comprises an amino acid sequence that differs from SEQ ID NO: 10021 by up to five, four, three, or two amino acids.
226. The antibody or antigen-binding fragment of any of embodiments 206-225, provided that the LCDR3 comprises SEQ ID NO: 10024.
227. The antibody or antigen-binding fragment of any of embodiments 206-225, provided that the LCDR3 comprises SEQ ID NO: 100155.
228. The antibody or antigen-binding fragment of embodiment 227, provided that $X_1$ is N.
229. The antibody or antigen-binding fragment of embodiment 227 or embodiment 228, provided that $X_2$ is selected from D, E, H, N, and Q.
230. The antibody or antigen-binding fragment of any of embodiments 227-229, provided that $X_3$ is A.
231. The antibody or antigen-binding fragment of any of embodiments 227-230, provided that $X_4$ is selected from D, F, K, R, S, and T.
232. The antibody or antigen-binding fragment of any of embodiments 227-231, provided that the LCDR3 comprises an amino acid sequence selected from SEQ ID NOS: 100315-100482.
233. The antibody or antigen-binding fragment of embodiment 206, provided that the HCDR1 comprises SEQ ID NO: 1009, the HCDR2 comprises SEQ ID NO: 10012, the HCDR3 comprises SEQ ID NO: 10015, the LCDR1 comprises SEQ ID NO: 10018, the LCDR2 comprises SEQ ID NO: 10021, and the LCDR3 comprises SEQ ID NO: 10024.
234. The antibody or antigen-binding fragment of embodiment 206, provided that the HCDR1 comprises SEQ ID NO: 100150, the HCDR2 comprises SEQ ID NO: 10012, the HCDR3 comprises SEQ ID NO: 100152, the LCDR1 comprises SEQ ID NO: 10018, the LCDR2 comprises SEQ ID NO: 10021, and the LCDR3 comprises SEQ ID NO: 100155.
235. The antibody or antigen-binding fragment of embodiment 206 or embodiment 234, provided that the $X_1$ of SEQ ID NO: 100150 is D.
236. The antibody or antigen-binding fragment of embodiment 206 or embodiment 234 provided that the $X_1$ of SEQ ID NO: 100150 is E.
237. The antibody or antigen-binding fragment of any of embodiments 206, 234-236, provided that the $X_2$ of SEQ ID NO: 100150 is I.
238. The antibody or antigen-binding fragment of any of embodiments 206, 234-236, provided that the $X_2$ of SEQ ID NO: 100150 is P.
239. The antibody or antigen-binding fragment of any of embodiments 206, 234-236, provided that the $X_2$ of SEQ ID NO: 100150 is V.
240. The antibody or antigen-binding fragment of any of embodiments 206, 234-239, provided that the $X_3$ of SEQ ID NO: 100150 is G.
241. The antibody or antigen-binding fragment of any of embodiments 206, 234-239, provided that the $X_3$ of SEQ ID NO: 100150 is Q.
242. The antibody or antigen-binding fragment of any of embodiments 206, 234-239, provided that the $X_3$ of SEQ ID NO: 100150 is S.
243. The antibody or antigen-binding fragment of any of embodiments 206, 234-239, provided that the $X_3$ of SEQ ID NO: 100150 is V.
244. The antibody or antigen-binding fragment of any of embodiments 206, 234-243, provided that the $X_4$ of SEQ ID NO: 100150 is F.
245. The antibody or antigen-binding fragment of any of embodiments 206, 234-243, provided that the $X_4$ of SEQ ID NO: 100150 is Y.
246. The antibody or antigen-binding fragment of any of embodiments 206, 234-245, provided that the $X_5$ of SEQ ID NO: 100150 is I.

247. The antibody or antigen-binding fragment of any of embodiments 206, 234-245, provided that the $X_5$ of SEQ ID NO: 100150 is M.
248. The antibody or antigen-binding fragment of any of embodiments 206, 234-247, provided that the $X_1$ of SEQ ID NO: 100152 is L.
249. The antibody or antigen-binding fragment of any of embodiments 206, 234-247, provided that the $X_1$ of SEQ ID NO: 100152 is M.
250. The antibody or antigen-binding fragment of any of embodiments 206, 234-249, provided that the $X_2$ of SEQ ID NO: 100152 is E.
251. The antibody or antigen-binding fragment of any of embodiments 206, 234-249, provided that the $X_2$ of SEQ ID NO: 100152 is I.
252. The antibody or antigen-binding fragment of any of embodiments 206, 234-249, provided that the $X_2$ of SEQ ID NO: 100152 is K.
253. The antibody or antigen-binding fragment of any of embodiments 206, 234-249, provided that the $X_2$ of SEQ ID NO: 100152 is L.
254. The antibody or antigen-binding fragment of any of embodiments 206, 234-249, provided that the $X_2$ of SEQ ID NO: 100152 is M.
255. The antibody or antigen-binding fragment of any of embodiments 206, 234-249, provided that the $X_2$ of SEQ ID NO: 100152 is Q.
256. The antibody or antigen-binding fragment of any of embodiments 206, 234-249, provided that the $X_2$ of SEQ ID NO: 100152 is T.
257. The antibody or antigen-binding fragment of any of embodiments 206, 234-249, provided that the $X_2$ of SEQ ID NO: 100152 is V.
258. The antibody or antigen-binding fragment of any of embodiments 206, 234-249, provided that the $X_2$ of SEQ ID NO: 100152 is W.
259. The antibody or antigen-binding fragment of any of embodiments 206, 234-249, provided that the $X_2$ of SEQ ID NO: 100152 is Y.
260. The antibody or antigen-binding fragment of any of embodiments 206, 234-259, provided that the $X_1$ of SEQ ID NO: 100155 is Q.
261. The antibody or antigen-binding fragment of any of embodiments 206, 234-259, provided that the $X_1$ of SEQ ID NO: 100155 is N.
262. The antibody or antigen-binding fragment of any of embodiments 206, 234-261, provided that the $X_2$ of SEQ ID NO: 100155 is D.
263. The antibody or antigen-binding fragment of any of embodiments 206, 234-261, provided that the $X_2$ of SEQ ID NO: 100155 is E.
264. The antibody or antigen-binding fragment of any of embodiments 206, 234-261, provided that the $X_2$ of SEQ ID NO: 100155 is H.
265. The antibody or antigen-binding fragment of any of embodiments 206, 234-261, provided that the $X_2$ of SEQ ID NO: 100155 is N.
266. The antibody or antigen-binding fragment of any of embodiments 206, 234-261, provided that the $X_2$ of SEQ ID NO: 100155 is Q.
267. The antibody or antigen-binding fragment of any of embodiments 206, 234-261, provided that the $X_2$ of SEQ ID NO: 100155 is S.
268. The antibody or antigen-binding fragment of any of embodiments 206, 234-267, provided that the $X_3$ of SEQ ID NO: 100155 is A.
269. The antibody or antigen-binding fragment of any of embodiments 206, 234-267, provided that the $X_3$ of SEQ ID NO: 100155 is G.
270. The antibody or antigen-binding fragment of any of embodiments 206, 234-269, provided that the $X_4$ of SEQ ID NO: 100155 is D.
271. The antibody or antigen-binding fragment of any of embodiments 206, 234-269, provided that the $X_4$ of SEQ ID NO: 100155 is F.
272. The antibody or antigen-binding fragment of any of embodiments 206, 234-269, provided that the $X_4$ of SEQ ID NO: 100155 is K.
273. The antibody or antigen-binding fragment of any of embodiments 206, 234-269, provided that the $X_4$ of SEQ ID NO: 100155 is N.
274. The antibody or antigen-binding fragment of any of embodiments 206, 234-269, provided that the $X_4$ of SEQ ID NO: 100155 is R.
275. The antibody or antigen-binding fragment of any of embodiments 206, 234-269, provided that the $X_4$ of SEQ ID NO: 100155 is S.
276. The antibody or antigen-binding fragment of any of embodiments 206, 234-269, provided that the $X_4$ of SEQ ID NO: 100155 is T.
277. The antibody or antigen-binding fragment of any of embodiments 206-276, provided that the antibody or antigen-binding fragment specifically binds to human TL1A.
278. The antibody or antigen-binding fragment of embodiment 277, provided that the antibody or antigen-binding fragment specifically binds to human TL1A with a $K_d$ of $1\times10^{-9}$ M or less.
279. The antibody or antigen-binding fragment of embodiment 278, provided that the $K_d$ is measured using a method selected from a standard ELISA assay and SPR.
280. The antibody or antigen-binding fragment of any of embodiments 206-279, provided that the antibody or antigen-binding fragment inhibits binding of DR3 to human TL1A.
281. The antibody or antigen-binding fragment of any of embodiments 206-280, provided that the antibody or antigen-binding fragment inhibits binding of DcR3 to human TL1A.
282. The antibody or antigen-binding fragment of any of embodiments 206-281, provided that the antibody or antigen-binding fragment is a humanized antibody, a CDR-grafted antibody, a chimeric antibody, a Fab, a ScFv, or a combination thereof.
283. The antibody or antigen-binding fragment of any of embodiments 206-282, comprising a human CH1 domain.
284. The antibody or antigen-binding fragment of any of embodiments 206-283, comprising a human CH2 domain.
285. The antibody or antigen-binding fragment of embodiment 284, provided that that CH2 domain comprises at least one mutation selected from L234A, L235A, and G237A, as numbered using Kabat.
286. The antibody or antigen-binding fragment of any of embodiments 206-285, comprising a human CH3 domain.
287. A pharmaceutical composition comprising a therapeutically effective amount of the antibody or antigen-binding fragment of any of embodiments 206-286, and a pharmaceutically acceptable carrier.
288. A method of treating an inflammatory disease in a subject in need thereof, comprising administering to the subject a therapeutically effective amount of the antibody or antigen-binding fragment of any of embodiments 206-287.

289. The method of embodiment 288, provided that the inflammatory disease is inflammatory bowel disease.
290. The method of embodiment 289, provided that the inflammatory bowel disease comprises Crohn's disease.
291. The method of embodiment 290, provided that the subject has been determined to be non-responsive to anti-TNF alpha therapy.
292. The method of embodiment 290 or embodiment 291, provided that the subject has been determined to comprise a disease phenotype comprising non-stricturing/non-penetrating, stricturing, stricturing and penetrating, or isolated internal penetrating.
293. An antibody or antigen-binding fragment that specifically binds to TL1A, comprising:
   a heavy chain variable region comprising four heavy chain framework regions (HFR1, HFR2, HFR3, and HFR4) comprising SEQ ID NOS: 100108, 100101, 100109, and 100103, respectively, and three heavy chain complementarity-determining regions (HCDR1, HCDR2, and HCDR3) comprising:
      (a) a HCDR1 selected from: (i) a HCDR1 comprising SEQ ID NO: 1009, (ii) a HCDR1 comprising SEQ ID NO: 100150, wherein $X_1$ is selected from D and E, $X_2$ is selected from I, P and V, $X_3$ is selected from G, Q, S, and V, $X_4$ is selected from F and Y, and $X_5$ is selected from I and M, (iii) a HCDR1 selected from SEQ ID NOS: 100200-100295, and (iv) a HCDR1 comprising an amino acid sequence that differs from a sequence selected from the group consisting of SEQ ID NOS: 1009, 100150 and 100200-100295 by up to five, four, three, or two amino acids,
      (b) a HCDR2 selected from: (i) a HCDR2 comprising SEQ ID NO: 10012, and (ii) a HCDR2 comprising an amino acid sequence that differs from SEQ ID NO: 10012 by up to five, four, three, or two amino acids, and
      (c) a HCDR3 selected from (i) a HCDR3 comprising SEQ ID NO: 10015, (ii) a HCDR3 comprising SEQ ID NO: 100152, wherein $X_1$ is selected from L and M, and $X_2$ is selected from E, I, K, L, M, Q, T, V, W, and Y, (iii) a HCDR3 selected from SEQ ID NOS: 100296-100314, and (iv) a HCDR3 comprising an amino acid sequence that differs from a sequence selected from the group consisting of SEQ ID NOS: 10015, 100152 and 100296-100314 by up to five, four, three, or two amino acids; and
   a light chain variable region comprising four light chain framework regions (LFR1, LFR2, LFR3, and LFR4) comprising SEQ ID NOS: 100104-100107, and three light chain complementarity-determining regions (LCDR1, LCDR2, and LCDR3) comprising:
      (a) a LCDR1 selected from: (i) a LCDR1 comprising SEQ ID NO: 10018, and (ii) a LCDR1 comprising an amino acid sequence that differs from SEQ ID NO: 10018 by up to five, four, three, or two amino acids,
      (b) a LCDR2 selected from: (i) a LCDR2 comprising SEQ ID NO: 10021, and (ii) a LCDR2 comprising an amino acid sequence that differs from SEQ ID NO: 10021 by up to five, four, three, or two amino acids, and
      (c) a LCDR3 selected from (i) a LCDR3 comprising SEQ ID NO: 10024, (ii) a LCDR3 comprising SEQ ID NO: 100155, wherein $X_1$ is selected from Q and N, $X_2$ is selected from D, E, H, N, Q, and S, $X_3$ is selected from A and G, and $X_4$ is selected from D, F, K, N, R, S, and T, (iii) a LCDR3 selected from SEQ ID NOS: 100315-100482, and (iv) a LCDR3 comprising an amino acid sequence that differs from a sequence selected from the group consisting of SEQ ID NOS: 10024, 100155, and 100315-100482 by up to five, four, three, or two amino acids.
294. The antibody or antigen-binding fragment of embodiment 293, provided that the HCDR1 comprises SEQ ID NO: 1009.
295. The antibody or antigen-binding fragment of embodiment 293, provided that the HCDR1 comprises SEQ ID NO: 100150.
296. The antibody or antigen-binding fragment of embodiment 295, provided that $X_1$ is E.
297. The antibody or antigen-binding fragment of embodiment 295 or embodiment 296, provided that $X_2$ is selected from P and V.
298. The antibody or antigen-binding fragment of any of embodiments 295-297, provided that $X_3$ is selected from G, S, and V.
299. The antibody or antigen-binding fragment of any of embodiments 295-298, provided that $X_4$ is F.
300. The antibody or antigen-binding fragment of any of embodiments 295-299, provided that $X_5$ is I.
301. The antibody or antigen-binding fragment of embodiment 293, provided that the HCDR1 comprises an amino acid sequence selected from SEQ ID NOS: 100200-100295.
302. The antibody or antigen-binding fragment of any of embodiments 293-301, provided that the HCDR2 comprises SEQ ID NO: 10012.
303. The antibody or antigen-binding fragment of any of embodiments 293-301 provided that the HCDR2 comprises an amino acid sequence that differs from SEQ ID NO: 10012 by up to five, four, three, or two amino acids.
304. The antibody or antigen-binding fragment of any of embodiments 293-303, provided that the HCDR3 comprises SEQ ID NO: 10015.
305. The antibody or antigen-binding fragment of any of embodiments 293-303, provided that the HCDR3 comprises SEQ ID NO: 100152.
306. The antibody or antigen-binding fragment of embodiment 305, provided that $X_1$ is M.
307. The antibody or antigen-binding fragment of embodiment 305 or embodiment 306, provided that $X_2$ is selected from E, I, K, L, M, Q, T, W, and Y.
308. The antibody or antigen-binding fragment of any of embodiments 293-303, provided that the HCDR3 comprises a sequence selected from SEQ ID NOS: 100296-100314.
309. The antibody or antigen-binding fragment of any of embodiments 293-308, provided that the LCDR1 comprises SEQ ID NO: 10018.
310. The antibody or antigen-binding fragment of any of embodiments 293-308, provided that the LCDR1 comprises an amino acid sequence that differs from SEQ ID NO: 10018 by up to five, four, three, or two amino acids.
311. The antibody or antigen-binding fragment of any of embodiments 293-310, provided that the LCDR2 comprises SEQ ID NO: 10021.
312. The antibody or antigen-binding fragment of any of embodiments 293-310, provided that the LCDR2 comprises an amino acid sequence that differs from SEQ ID NO: 10021 by up to five, four, three, or two amino acids.
313. The antibody or antigen-binding fragment of any of embodiments 293-312, provided that the LCDR3 comprises SEQ ID NO: 10024.

314. The antibody or antigen-binding fragment of any of embodiments 293-312, provided that the LCDR3 comprises SEQ ID NO: 100155.
315. The antibody or antigen-binding fragment of embodiment 314, provided that $X_1$ is N.
316. The antibody or antigen-binding fragment of embodiment 314 or embodiment 315, provided that $X_2$ is selected from D, E, H, N, and Q.
317. The antibody or antigen-binding fragment of any of embodiments 314-316, provided that $X_3$ is A.
318. The antibody or antigen-binding fragment of any of embodiments 314-317, provided that $X_4$ is selected from D, F, K, R, S, and T.
319. The antibody or antigen-binding fragment of any of embodiments 314-312, provided that the LCDR3 comprises an amino acid sequence selected from SEQ ID NOS: 100315-100482.
320. The antibody or antigen-binding fragment of embodiment 293, provided that the HCDR1 comprises SEQ ID NO: 1009, the HCDR2 comprises SEQ ID NO: 10012, the HCDR3 comprises SEQ ID NO: 10015, the LCDR1 comprises SEQ ID NO: 10018, the LCDR2 comprises SEQ ID NO: 10021, and the LCDR3 comprises SEQ ID NO: 10024.
321. The antibody or antigen-binding fragment of embodiment 293, provided that the HCDR1 comprises SEQ ID NO: 100150, the HCDR2 comprises SEQ ID NO: 10012, the HCDR3 comprises SEQ ID NO: 100152, the LCDR1 comprises SEQ ID NO: 10018, the LCDR2 comprises SEQ ID NO: 10021, and the LCDR3 comprises SEQ ID NO: 100155.
322. The antibody or antigen-binding fragment of embodiment 293 or embodiment 321, provided that the $X_1$ of SEQ ID NO: 100150 is D.
323. The antibody or antigen-binding fragment of embodiment 293 or embodiment 321 provided that the $X_1$ of SEQ ID NO: 100150 is E.
324. The antibody or antigen-binding fragment of any of embodiments 293, 321-323, provided that the $X_2$ of SEQ ID NO: 100150 is I.
325. The antibody or antigen-binding fragment of any of embodiments 293, 321-323, provided that the $X_2$ of SEQ ID NO: 100150 is P.
326. The antibody or antigen-binding fragment of any of embodiments 293, 321-323, provided that the $X_2$ of SEQ ID NO: 100150 is V.
327. The antibody or antigen-binding fragment of any of embodiments 293, 321-326, provided that the $X_3$ of SEQ ID NO: 100150 is G.
328. The antibody or antigen-binding fragment of any of embodiments 293, 321-326, provided that the $X_3$ of SEQ ID NO: 100150 is Q.
329. The antibody or antigen-binding fragment of any of embodiments 293, 321-326, provided that the $X_3$ of SEQ ID NO: 100150 is S.
330. The antibody or antigen-binding fragment of any of embodiments 293, 321-326, provided that the $X_3$ of SEQ ID NO: 100150 is V.
331. The antibody or antigen-binding fragment of any of embodiments 293, 321-330, provided that the $X_4$ of SEQ ID NO: 100150 is F.
332. The antibody or antigen-binding fragment of any of embodiments 293, 321-330, provided that the $X_4$ of SEQ ID NO: 100150 is Y.
333. The antibody or antigen-binding fragment of any of embodiments 293, 321-332, provided that the $X_5$ of SEQ ID NO: 100150 is I.
334. The antibody or antigen-binding fragment of any of embodiments 293, 321-332, provided that the $X_5$ of SEQ ID NO: 100150 is M.
335. The antibody or antigen-binding fragment of any of embodiments 293, 321-334, provided that the $X_1$ of SEQ ID NO: 100152 is L.
336. The antibody or antigen-binding fragment of any of embodiments 293, 321-334, provided that the $X_1$ of SEQ ID NO: 100152 is M.
337. The antibody or antigen-binding fragment of any of embodiments 293, 321-336, provided that the $X_2$ of SEQ ID NO: 100152 is E.
338. The antibody or antigen-binding fragment of any of embodiments 293, 321-336, provided that the $X_2$ of SEQ ID NO: 100152 is I.
339. The antibody or antigen-binding fragment of any of embodiments 293, 321-336, provided that the $X_2$ of SEQ ID NO: 100152 is K.
340. The antibody or antigen-binding fragment of any of embodiments 293, 321-336, provided that the $X_2$ of SEQ ID NO: 100152 is L.
341. The antibody or antigen-binding fragment of any of embodiments 293, 321-336, provided that the $X_2$ of SEQ ID NO: 100152 is M.
342. The antibody or antigen-binding fragment of any of embodiments 293, 321-336, provided that the $X_2$ of SEQ ID NO: 100152 is Q.
343. The antibody or antigen-binding fragment of any of embodiments 293, 321-336, provided that the $X_2$ of SEQ ID NO: 100152 is T.
344. The antibody or antigen-binding fragment of any of embodiments 293, 321-336, provided that the $X_2$ of SEQ ID NO: 100152 is V.
345. The antibody or antigen-binding fragment of any of embodiments 293, 321-336, provided that the $X_2$ of SEQ ID NO: 100152 is W.
346. The antibody or antigen-binding fragment of any of embodiments 293, 321-336, provided that the $X_2$ of SEQ ID NO: 100152 is Y.
347. The antibody or antigen-binding fragment of any of embodiments 293, 321-346, provided that the $X_1$ of SEQ ID NO: 100155 is Q.
348. The antibody or antigen-binding fragment of any of embodiments 293, 321-346, provided that the $X_1$ of SEQ ID NO: 100155 is N.
349. The antibody or antigen-binding fragment of any of embodiments 293, 321-348, provided that the $X_2$ of SEQ ID NO: 100155 is D.
350. The antibody or antigen-binding fragment of any of embodiments 293, 321-348, provided that the $X_2$ of SEQ ID NO: 100155 is E.
351. The antibody or antigen-binding fragment of any of embodiments 293, 321-348, provided that the $X_2$ of SEQ ID NO: 100155 is H.
352. The antibody or antigen-binding fragment of any of embodiments 293, 321-348, provided that the $X_2$ of SEQ ID NO: 100155 is N.
353. The antibody or antigen-binding fragment of any of embodiments 293, 321-348, provided that the $X_2$ of SEQ ID NO: 100155 is Q.
354. The antibody or antigen-binding fragment of any of embodiments 293, 321-348, provided that the $X_2$ of SEQ ID NO: 100155 is S.
355. The antibody or antigen-binding fragment of any of embodiments 293, 321-354, provided that the $X_3$ of SEQ ID NO: 100155 is A.

356. The antibody or antigen-binding fragment of any of embodiments 293, 321-354, provided that the X$_3$ of SEQ ID NO: 100155 is G.

357. The antibody or antigen-binding fragment of any of embodiments 293, 321-356, provided that the X$_4$ of SEQ ID NO: 100155 is D.

358. The antibody or antigen-binding fragment of any of embodiments 293, 321-356, provided that the X$_4$ of SEQ ID NO: 100155 is F.

359. The antibody or antigen-binding fragment of any of embodiments 293, 321-356, provided that the X$_4$ of SEQ ID NO: 100155 is K.

360. The antibody or antigen-binding fragment of any of embodiments 293, 321-356, provided that the X$_4$ of SEQ ID NO: 100155 is N.

361. The antibody or antigen-binding fragment of any of embodiments 293, 321-356, provided that the X$_4$ of SEQ ID NO: 100155 is R.

362. The antibody or antigen-binding fragment of any of embodiments 293, 321-356, provided that the X$_4$ of SEQ ID NO: 100155 is S.

363. The antibody or antigen-binding fragment of any of embodiments 293, 321-356, provided that the X$_4$ of SEQ ID NO: 100155 is T.

364. The antibody or antigen-binding fragment of any of embodiments 293-363, provided that the antibody or antigen-binding fragment specifically binds to human TL1A.

365. The antibody or antigen-binding fragment of embodiment 364, provided that the antibody or antigen-binding fragment specifically binds to human TL1A with a K$_d$ of $1\times10^{-9}$ M or less.

366. The antibody or antigen-binding fragment of embodiment 365, provided that the K$_d$ is measured using a method selected from a standard ELISA assay and SPR.

367. The antibody or antigen-binding fragment of any of embodiments 293-366, provided that the antibody or antigen-binding fragment inhibits binding of DR3 to human TL1A.

368. The antibody or antigen-binding fragment of any of embodiments 293-367, provided that the antibody or antigen-binding fragment inhibits binding of DcR3 to human TL1A.

369. The antibody or antigen-binding fragment of any of embodiments 293-368, provided that the antibody or antigen-binding fragment is a humanized antibody, a CDR-grafted antibody, a chimeric antibody, a Fab, a ScFv, or a combination thereof 370. The antibody or antigen-binding fragment of any of embodiments 293-369, comprising a human CH1 domain.

371. The antibody or antigen-binding fragment of any of embodiments 293-370, comprising a human CH2 domain.

372. The antibody or antigen-binding fragment of embodiment 371, provided that that CH2 domain comprises at least one mutation selected from L234A, L235A, and G237A, as numbered using Kabat.

373. The antibody or antigen-binding fragment of any of embodiments 293-372, comprising a human CH3 domain.

374. A pharmaceutical composition comprising a therapeutically effective amount of the antibody or antigen-binding fragment of any of embodiments 293-373, and a pharmaceutically acceptable carrier.

375. A method of treating an inflammatory disease in a subject in need thereof, comprising administering to the subject a therapeutically effective amount of the antibody or antigen-binding fragment of any of embodiments 293-373.

376. The method of embodiment 375, provided that the inflammatory disease is inflammatory bowel disease.

377. The method of embodiment 376, provided that the inflammatory bowel disease comprises Crohn's disease.

378. The method of embodiment 377, provided that the subject has been determined to be non-responsive to anti-TNF alpha therapy.

379. The method of embodiment 377 or embodiment 378, provided that the subject has been determined to comprise a disease phenotype comprising non-stricturing/non-penetrating, stricturing, stricturing and penetrating, or isolated internal penetrating.

380. An antibody or antigen-binding fragment that specifically binds to TL1A, comprising:
a heavy chain variable region comprising three heavy chain complementarity-determining regions (HCDR1, HCDR2, and HCDR3) comprising
(a) a HCDR1 selected from: (i) a HCDR1 comprising SEQ ID NO: 1009, (ii) a HCDR1 comprising SEQ ID NO: 100150, wherein X$_1$ is selected from D and E, X$_2$ is selected from I, P and V, X$_3$ is selected from G, Q, S, and V, X$_4$ is selected from F and Y, and X$_5$ is selected from I and M, (iii) a HCDR1 selected from SEQ ID NOS: 100200-100295, and (iv) a HCDR1 comprising an amino acid sequence that differs from a sequence selected from the group consisting of SEQ ID NOS: 1009, 100150 and 100200-100295 by up to five, four, three, or two amino acids,
(b) a HCDR2 selected from: (i) a HCDR2 comprising SEQ ID NO: 10012, and (ii) a HCDR2 comprising an amino acid sequence that differs from SEQ ID NO: 10012 by up to five, four, three, or two amino acids, and
(c) a HCDR3 selected from (i) a HCDR3 comprising SEQ ID NO: 10015, (ii) a HCDR3 comprising SEQ ID NO: 100152, wherein X$_1$ is selected from L and M, and X$_2$ is selected from E, I, K, L, M, Q, T, V, W, and Y, (iii) a HCDR3 selected from SEQ ID NOS: 100296-100314, and (iv) a HCDR3 comprising an amino acid sequence that differs from a sequence selected from the group consisting of SEQ ID NOS: 10015, 100152 and 100296-100314 by up to five, four, three, or two amino acids; and
a light chain variable region comprising three light chain complementarity-determining regions (LCDR1, LCDR2, and LCDR3) comprising:
(a) a LCDR1 selected from: (i) a LCDR1 comprising SEQ ID NO: 10018, and (ii) a LCDR1 comprising an amino acid sequence that differs from SEQ ID NO: 10018 by up to five, four, three, or two amino acids,
(b) a LCDR2 selected from: (i) a LCDR2 comprising SEQ ID NO: 10021, and (ii) a LCDR2 comprising an amino acid sequence that differs from SEQ ID NO: 10021 by up to five, four, three, or two amino acids, and
(c) a LCDR3 selected from (i) a LCDR3 comprising SEQ ID NO: 10024, (ii) a LCDR3 comprising SEQ ID NO: 100155, wherein X$_1$ is selected from Q and N, X$_2$ is selected from D, E, H, N, Q, and S, X$_3$ is selected from A and G, and X$_4$ is selected from D, F, K, N, R, S, and T, (iii) a LCDR3 selected from SEQ ID NOS: 100315-100482, and (iv) a LCDR3 comprising an amino acid sequence that differs from a sequence selected from the group consisting of SEQ ID NOS: 10024, 100155, and 100315-100482 by up to five, four, three, or two amino acids.

381. The antibody or antigen-binding fragment of embodiment 380, provided that the HCDR1 comprises SEQ ID NO: 100150, the HCDR2 comprises SEQ ID NO: 10012, the HCDR3 comprises SEQ ID NO: 100152, the LCDR1 comprises SEQ ID NO: 10018, the LCDR2 comprises SEQ ID NO: 10021, and the LCDR3 comprises SEQ ID NO: 100155.

382. The antibody or antigen-binding fragment of embodiment 380 or embodiment 381, provided that the $X_1$ of SEQ ID NO: 100150 is D.

383. The antibody or antigen-binding fragment of embodiment 380 or embodiment 381 provided that the $X_1$ of SEQ ID NO: 100150 is E.

384. The antibody or antigen-binding fragment of any of embodiments 380-383, provided that the $X_2$ of SEQ ID NO: 100150 is I.

385. The antibody or antigen-binding fragment of any of embodiments 380-383, provided that the $X_2$ of SEQ ID NO: 100150 is P.

386. The antibody or antigen-binding fragment of any of embodiments 380-383, provided that the $X_2$ of SEQ ID NO: 100150 is V.

387. The antibody or antigen-binding fragment of any of embodiments 380-386, provided that the $X_3$ of SEQ ID NO: 100150 is G.

388. The antibody or antigen-binding fragment of any of embodiments 380-386, provided that the $X_3$ of SEQ ID NO: 100150 is Q.

389. The antibody or antigen-binding fragment of any of embodiments 380-386, provided that the $X_3$ of SEQ ID NO: 100150 is S.

390. The antibody or antigen-binding fragment of any of embodiments 380-386, provided that the $X_3$ of SEQ ID NO: 100150 is V.

391. The antibody or antigen-binding fragment of any of embodiments 380-390, provided that the $X_4$ of SEQ ID NO: 100150 is F.

392. The antibody or antigen-binding fragment of any of embodiments 380-390, provided that the $X_4$ of SEQ ID NO: 100150 is Y.

393. The antibody or antigen-binding fragment of any of embodiments 380-392, provided that the $X_5$ of SEQ ID NO: 100150 is I.

394. The antibody or antigen-binding fragment of any of embodiments 380-392, provided that the $X_5$ of SEQ ID NO: 100150 is M.

395. The antibody or antigen-binding fragment of any of embodiments 380-394, provided that the $X_1$ of SEQ ID NO: 100152 is L.

396. The antibody or antigen-binding fragment of any of embodiments 380-394, provided that the $X_1$ of SEQ ID NO: 100152 is M.

397. The antibody or antigen-binding fragment of any of embodiments 380-396, provided that the $X_2$ of SEQ ID NO: 100152 is E.

398. The antibody or antigen-binding fragment of any of embodiments 380-396, provided that the $X_2$ of SEQ ID NO: 100152 is I.

399. The antibody or antigen-binding fragment of any of embodiments 380-396, provided that the $X_2$ of SEQ ID NO: 100152 is K.

400. The antibody or antigen-binding fragment of any of embodiments 380-396, provided that the $X_2$ of SEQ ID NO: 100152 is L.

401. The antibody or antigen-binding fragment of any of embodiments 380-396, provided that the $X_2$ of SEQ ID NO: 100152 is M.

402. The antibody or antigen-binding fragment of any of embodiments 380-396, provided that the $X_2$ of SEQ ID NO: 100152 is Q.

403. The antibody or antigen-binding fragment of any of embodiments 380-396, provided that the $X_2$ of SEQ ID NO: 100152 is T.

404. The antibody or antigen-binding fragment of any of embodiments 380-396, provided that the $X_2$ of SEQ ID NO: 100152 is V.

405. The antibody or antigen-binding fragment of any of embodiments 380-396, provided that the $X_2$ of SEQ ID NO: 100152 is W.

406. The antibody or antigen-binding fragment of any of embodiments 380-396, provided that the $X_2$ of SEQ ID NO: 100152 is Y.

407. The antibody or antigen-binding fragment of any of embodiments 380-406, provided that the $X_1$ of SEQ ID NO: 100155 is Q.

408. The antibody or antigen-binding fragment of any of embodiments 380-406, provided that the $X_1$ of SEQ ID NO: 100155 is N.

409. The antibody or antigen-binding fragment of any of embodiments 380-408, provided that the $X_2$ of SEQ ID NO: 100155 is D.

410. The antibody or antigen-binding fragment of any of embodiments 380-408, provided that the $X_2$ of SEQ ID NO: 100155 is E.

411. The antibody or antigen-binding fragment of any of embodiments 380-408, provided that the $X_2$ of SEQ ID NO: 100155 is H.

412. The antibody or antigen-binding fragment of any of embodiments 380-408, provided that the $X_2$ of SEQ ID NO: 100155 is N.

413. The antibody or antigen-binding fragment of any of embodiments 380-408, provided that the $X_2$ of SEQ ID NO: 100155 is Q.

414. The antibody or antigen-binding fragment of any of embodiments 380-408, provided that the $X_2$ of SEQ ID NO: 100155 is S.

415. The antibody or antigen-binding fragment of any of embodiments 380-414, provided that the $X_3$ of SEQ ID NO: 100155 is A.

416. The antibody or antigen-binding fragment of any of embodiments 380-414, provided that the $X_3$ of SEQ ID NO: 100155 is G.

417. The antibody or antigen-binding fragment of any of embodiments 380-416, provided that the $X_4$ of SEQ ID NO: 100155 is D.

418. The antibody or antigen-binding fragment of any of embodiments 380-416, provided that the $X_4$ of SEQ ID NO: 100155 is F.

419. The antibody or antigen-binding fragment of any of embodiments 380-416, provided that the $X_4$ of SEQ ID NO: 100155 is K.

420. The antibody or antigen-binding fragment of any of embodiments 380-416, provided that the $X_4$ of SEQ ID NO: 100155 is N.

421. The antibody or antigen-binding fragment of any of embodiments 380-416, provided that the $X_4$ of SEQ ID NO: 100155 is R.

422. The antibody or antigen-binding fragment of any of embodiments 380-416, provided that the $X_4$ of SEQ ID NO: 100155 is S.

423. The antibody or antigen-binding fragment of any of embodiments 380-416, provided that the $X_4$ of SEQ ID NO: 100155 is T.
424. The antibody or antigen-binding fragment of any of embodiments 380-423, provided that the antibody or antigen-binding fragment specifically binds to human TL1A.
425. The antibody or antigen-binding fragment of embodiment 424, provided that the antibody or antigen-binding fragment specifically binds to human TL1A with a $K_d$ of $1 \times 10^{-9}$ M or less.
426. The antibody or antigen-binding fragment of embodiment 425, provided that the $K_d$ is measured using a method selected from a standard ELISA assay and SPR.
427. The antibody or antigen-binding fragment of any of embodiments 380-426, provided that the antibody or antigen-binding fragment inhibits binding of DR3 to human TL1A.
428. The antibody or antigen-binding fragment of any of embodiments 380-427, provided that the antibody or antigen-binding fragment inhibits binding of DcR3 to human TL1A.
429. The antibody or antigen-binding fragment of any of embodiments 380-428, provided that the antibody or antigen-binding fragment is a humanized antibody, a CDR-grafted antibody, a chimeric antibody, a Fab, a ScFv, or a combination thereof
430. The antibody or antigen-binding fragment of any of embodiments 380-429, comprising a human CH1 domain.
431. The antibody or antigen-binding fragment of any of embodiments 380-430, comprising a human CH2 domain.
432. The antibody or antigen-binding fragment of embodiment 431, provided that that CH2 domain comprises at least one mutation selected from L234A, L235A, and G237A, as numbered using Kabat.
433. The antibody or antigen-binding fragment of any of embodiments 380-432, comprising a human CH3 domain.
434. A pharmaceutical composition comprising a therapeutically effective amount of the antibody or antigen-binding fragment of any of embodiments 380-433, and a pharmaceutically acceptable carrier.
435. A method of treating an inflammatory disease in a subject in need thereof, comprising administering to the subject a therapeutically effective amount of the antibody or antigen-binding fragment of any of embodiments 380-433.
436. The method of embodiment 435, provided that the inflammatory disease is inflammatory bowel disease.
437. The method of embodiment 436, provided that the inflammatory bowel disease comprises Crohn's disease.
438. The method of embodiment 437, provided that the subject has been determined to be non-responsive to anti-TNF alpha therapy.
439. The method of embodiment 437 or embodiment 438, provided that the subject has been determined to comprise a disease phenotype comprising non-stricturing/non-penetrating, stricturing, stricturing and penetrating, or isolated internal penetrating.
440. An antibody or antigen-binding fragment that specifically binds to TL1A, comprising: a heavy chain variable region comprising SEQ ID NO: 10052 or SEQ ID NO: 10054, and a light chain variable region comprising SEQ ID NO: 10053.
441. The antibody or antigen-binding fragment of embodiment 440, provided that the heavy chain variable region comprises SEQ ID NO: 10052.
442. The antibody or antigen-binding fragment of embodiment 440, provided that the heavy chain variable region comprises SEQ ID NO: 10054.
443. The antibody or antigen-binding fragment of any of embodiments 440-442, provided that the $X_1$ of SEQ ID NO: 10052 or SEQ ID NO: 10054 is D.
444. The antibody or antigen-binding fragment of any of embodiments 440-442 provided that the $X_1$ of SEQ ID NO: 10052 or SEQ ID NO: 10054 is E.
445. The antibody or antigen-binding fragment of any of embodiments 440-444, provided that the $X_2$ of SEQ ID NO: 10052 or SEQ ID NO: 10054 is I.
446. The antibody or antigen-binding fragment of any of embodiments 440-444, provided that the $X_2$ of SEQ ID NO: 10052 or SEQ ID NO: 10054 is P.
447. The antibody or antigen-binding fragment of any of embodiments 440-444, provided that the $X_2$ of SEQ ID NO: 10052 or SEQ ID NO: 10054 is V.
448. The antibody or antigen-binding fragment of any of embodiments 440-447, provided that the $X_3$ of SEQ ID NO: 10052 or SEQ ID NO: 10054 is G.
449. The antibody or antigen-binding fragment of any of embodiments 440-447, provided that the $X_3$ of SEQ ID NO: 10052 or SEQ ID NO: 10054 is Q.
450. The antibody or antigen-binding fragment of any of embodiments 440-447, provided that the $X_3$ of SEQ ID NO: 10052 or SEQ ID NO: 10054 is S.
451. The antibody or antigen-binding fragment of any of embodiments 440-447, provided that the $X_3$ of SEQ ID NO: 10052 or SEQ ID NO: 10054 is V.
452. The antibody or antigen-binding fragment of any of embodiments 440-451, provided that the $X_4$ of SEQ ID NO: 10052 or SEQ ID NO: 10054 is F.
453. The antibody or antigen-binding fragment of any of embodiments 440-451, provided that the $X_4$ of SEQ ID NO: 10052 or SEQ ID NO: 10054 is Y.
454. The antibody or antigen-binding fragment of any of embodiments 440-453, provided that the $X_5$ of SEQ ID NO: 10052 or SEQ ID NO: 10054 is I.
455. The antibody or antigen-binding fragment of any of embodiments 440-453, provided that the $X_5$ of SEQ ID NO: 10052 or SEQ ID NO: 10054 is M.
456. The antibody or antigen-binding fragment of any of embodiments 440-455, provided that the $X_6$ of SEQ ID NO: 10052 or SEQ ID NO: 10054 is L.
457. The antibody or antigen-binding fragment of any of embodiments 440-455, provided that the $X_6$ of SEQ ID NO: 10052 or SEQ ID NO: 10054 is M.
458. The antibody or antigen-binding fragment of any of embodiments 440-457, provided that the $X_7$ of SEQ ID NO: 10052 or SEQ ID NO: 10054 is E.
459. The antibody or antigen-binding fragment of any of embodiments 440-457, provided that the $X_7$ of SEQ ID NO: 10052 or SEQ ID NO: 10054 is I.
460. The antibody or antigen-binding fragment of any of embodiments 440-457, provided that the $X_7$ of SEQ ID NO: 10052 or SEQ ID NO: 10054 is K.
461. The antibody or antigen-binding fragment of any of embodiments 440-457, provided that the $X_7$ of SEQ ID NO: 10052 or SEQ ID NO: 10054 is L.
462. The antibody or antigen-binding fragment of any of embodiments 440-457, provided that the $X_7$ of SEQ ID NO: 10052 or SEQ ID NO: 10054 is M.
463. The antibody or antigen-binding fragment of any of embodiments 440-457, provided that the $X_7$ of SEQ ID NO: 10052 or SEQ ID NO: 10054 is Q.

464. The antibody or antigen-binding fragment of any of embodiments 440-457, provided that the $X_7$ of SEQ ID NO: 10052 or SEQ ID NO: 10054 is T.

465. The antibody or antigen-binding fragment of any of embodiments 440-457, provided that the $X_7$ of SEQ ID NO: 10052 or SEQ ID NO: 10054 is V.

466. The antibody or antigen-binding fragment of any of embodiments 440-457, provided that the $X_7$ of SEQ ID NO: 10052 or SEQ ID NO: 10054 is W.

467. The antibody or antigen-binding fragment of any of embodiments 440-457, provided that the $X_7$ of SEQ ID NO: 10052 or SEQ ID NO: 10054 is Y.

468. The antibody or antigen-binding fragment of any of embodiments 440-467, provided that the $X_1$ of SEQ ID NO: 10053 is Q.

469. The antibody or antigen-binding fragment of any of embodiments 440-467, provided that the $X_1$ of SEQ ID NO: 10053 is N.

470. The antibody or antigen-binding fragment of any of embodiments 440-469, provided that the $X_2$ of SEQ ID NO: 10053 is D.

471. The antibody or antigen-binding fragment of any of embodiments 440-469, provided that the $X_2$ of SEQ ID NO: 10053 is E.

472. The antibody or antigen-binding fragment of any of embodiments 440-469, provided that the $X_2$ of SEQ ID NO: 10053 is H.

473. The antibody or antigen-binding fragment of any of embodiments 440-469, provided that the $X_2$ of SEQ ID NO: 10053 is N.

474. The antibody or antigen-binding fragment of any of embodiments 440-469, provided that the $X_2$ of SEQ ID NO: 10053 is Q.

475. The antibody or antigen-binding fragment of any of embodiments 440-469, provided that the $X_2$ of SEQ ID NO: 10053 is S.

476. The antibody or antigen-binding fragment of any of embodiments 440-475, provided that the $X_3$ of SEQ ID NO: 10053 is A.

477. The antibody or antigen-binding fragment of any of embodiments 440-475, provided that the $X_3$ of SEQ ID NO: 10053 is G.

478. The antibody or antigen-binding fragment of any of embodiments 440-477, provided that the $X_4$ of SEQ ID NO: 10053 is D.

479. The antibody or antigen-binding fragment of any of embodiments 440-477, provided that the $X_4$ of SEQ ID NO: 10053 is F.

480. The antibody or antigen-binding fragment of any of embodiments 440-477, provided that the $X_4$ of SEQ ID NO: 10053 is K.

481. The antibody or antigen-binding fragment of any of embodiments 440-477, provided that the $X_4$ of SEQ ID NO: 10053 is N.

482. The antibody or antigen-binding fragment of any of embodiments 440-477, provided that the $X_4$ of SEQ ID NO: 10053 is R.

483. The antibody or antigen-binding fragment of any of embodiments 440-477, provided that the $X_4$ of SEQ ID NO: 10053 is S.

484. The antibody or antigen-binding fragment of any of embodiments 440-477, provided that the $X_4$ of SEQ ID NO: 10053 is T.

485. An antibody or antigen-binding fragment that specifically binds to TL1A, comprising: a heavy chain variable region of SEQ ID NO: 10036, and a light chain variable region of SEQ ID NO: 10038.

486. An antibody or antigen-binding fragment that specifically binds to TL1A, comprising: a heavy chain variable region of SEQ ID NO: 10040, and a light chain variable region of SEQ ID NO: 10042.

487. An antibody or antigen-binding fragment that specifically binds to TL1A, comprising: a heavy chain variable region of SEQ ID NO: 10040, and a light chain variable region of SEQ ID NO: 10038.

488. An antibody or antigen-binding fragment that specifically binds to TL1A, comprising: a heavy chain variable region of SEQ ID NO: 10044, and a light chain variable region of SEQ ID NO: 10038.

489. An antibody or antigen-binding fragment that specifically binds to TL1A, comprising: a heavy chain variable region of SEQ ID NO: 10043, and a light chain variable region of SEQ ID NO: 10038.

490. An antibody or antigen-binding fragment that specifically binds to TL1A, comprising: a heavy chain variable region of SEQ ID NO: 10045, and a light chain variable region of SEQ ID NO: 10038.

491. An antibody or antigen-binding fragment that specifically binds to TL1A, comprising: a heavy chain variable region of SEQ ID NO: 10046, and a light chain variable region of SEQ ID NO: 10038.

492. An antibody or antigen-binding fragment that specifically binds to TL1A, comprising: a heavy chain variable region of SEQ ID NO: 10040, and a light chain variable region of SEQ ID NO: 10047.

493. An antibody or antigen-binding fragment that specifically binds to TL1A, comprising: a heavy chain variable region of SEQ ID NO: 10040, and a light chain variable region of SEQ ID NO: 10048.

494. An antibody or antigen-binding fragment that specifically binds to TL1A, comprising: a heavy chain variable region of SEQ ID NO: 10040, and a light chain variable region of SEQ ID NO: 10049.

495. An antibody or antigen-binding fragment that specifically binds to TL1A, comprising: a heavy chain variable region of SEQ ID NO: 10040, and a light chain variable region of SEQ ID NO: 10050.

496. An antibody or antigen-binding fragment that specifically binds to TL1A, comprising: a heavy chain variable region of SEQ ID NO: 10040, and a light chain variable region of SEQ ID NO: 10051.

497. The antibody or antigen-binding fragment of any of embodiments 440-496, provided that the antibody or antigen-binding fragment specifically binds to human TL1A.

498. The antibody or antigen-binding fragment of embodiment 497, provided that the antibody or antigen-binding fragment specifically binds to human TL1A with a $K_d$ of $1 \times 10^{-9}$ M or less.

499. The antibody or antigen-binding fragment of embodiment 498, provided that the $K_d$ is measured using a method selected from a standard ELISA assay and SPR.

500. The antibody or antigen-binding fragment of any of embodiments 440-499, provided that the antibody or antigen-binding fragment inhibits binding of DR3 to human TL1A.

501. The antibody or antigen-binding fragment of any of embodiments 440-500, provided that the antibody or antigen-binding fragment inhibits binding of DcR3 to human TL1A.

502. The antibody or antigen-binding fragment of any of embodiments 440-501, provided that the antibody or antigen-binding fragment is a humanized antibody, a CDR-grafted antibody, a chimeric antibody, a Fab, a ScFv, or a combination thereof 503. The antibody or antigen-binding fragment of any of embodiments 440-502, comprising a human CH1 domain.

504. The antibody or antigen-binding fragment of any of embodiments 440-503, comprising a human CH2 domain.

505. The antibody or antigen-binding fragment of embodiment 504, provided that that CH2 domain comprises at least one mutation selected from L234A, L235A, and G237A, as numbered using Kabat.

506. The antibody or antigen-binding fragment of any of embodiments 440-505, comprising a human CH3 domain.

507. A pharmaceutical composition comprising a therapeutically effective amount of the antibody or antigen-binding fragment of any of embodiments 440-506, and a pharmaceutically acceptable carrier.

508. A method of treating an inflammatory disease in a subject in need thereof, comprising administering to the subject a therapeutically effective amount of the antibody or antigen-binding fragment of any of embodiments 440-506.

509. The method of embodiment 508, provided that the inflammatory disease is inflammatory bowel disease.

510. The method of embodiment 509, provided that the inflammatory bowel disease comprises Crohn's disease.

511. The method of embodiment 510, provided that the subject has been determined to be non-responsive to anti-TNF alpha therapy.

512. The method of embodiment 510 or embodiment 511, provided that the subject has been determined to comprise a disease phenotype comprising non-stricturing/non-penetrating, stricturing, stricturing and penetrating, or isolated internal penetrating.

513. An antibody or antigen binding fragment that binds to the same region of human TL1A as a reference antibody of any of embodiments 1-112, 119-199, 206-286, 293-373, 380-433, and 440-506.

514. An antibody or antigen binding fragment that binds to the same region of human TL1A as a reference antibody comprising a heavy chain variable region of SEQ ID NO: 10036, and a light chain variable region of SEQ ID NO: 10038.

515. An antibody or antigen binding fragment that binds to the same region of human TL1A as a reference antibody comprising a heavy chain variable region of SEQ ID NO: 10040, and a light chain variable region of SEQ ID NO: 10042.

516. An antibody or antigen binding fragment that binds to the same region of human TL1A as a reference antibody comprising a heavy chain variable region of SEQ ID NO: 10040, and a light chain variable region of SEQ ID NO: 10038.

517. An antibody or antigen-binding fragment that specifically binds to TL1A, comprising:
a heavy chain variable region comprising:
(a) an HCDR1 comprising an amino acid sequence set forth by SEQ ID NO: 553;
(b) an HCDR2 comprising an amino acid sequence set forth by any one of SEQ ID NOs: 554 to 564 or 574 to 577; and
(c) an HCDR3 comprising an amino acid sequence set forth by any one of SEQ ID NOs: 565 to 568 or 578 to 581; and
a light chain variable region comprising:
(d) an LCDR1 comprising an amino acid sequence set forth by any one of SEQ ID NOs: 569 or 570;
(e) an LCDR2 comprising an amino acid sequence set forth by SEQ ID NO: 488; and
(f) an LCDR3 comprising an amino acid sequence set forth by any one of SEQ ID NOs: 571 to 573 or 582 to 585.

518. An antibody or antigen-binding fragment that specifically binds to TL1A, comprising:
a heavy chain variable region comprising:
(a) an HCDR1 comprising an amino acid sequence set forth by SEQ ID NO: 553;
(b) an HCDR2 comprising an amino acid sequence set forth by SEQ ID NO: 559; and
(c) an HCDR3 comprising an amino acid sequence set forth by SEQ ID NO: 567; and
a light chain variable region comprising:
(d) an LCDR1 comprising an amino acid sequence set forth by SEQ ID NO: 569;
(e) an LCDR2 comprising an amino acid sequence set forth by SEQ ID NO: 488; and
(f) an LCDR3 comprising an amino acid sequence set forth by any one of SEQ ID NO: 573.

519. An antibody or antigen-binding fragment that specifically binds to TL1A, comprising:
a heavy chain variable region comprising:
(a) an HCDR1 comprising an amino acid sequence set forth by SEQ ID NO: 553;
(b) an HCDR2 comprising an amino acid sequence set forth by SEQ ID NO: 563; and
(c) an HCDR3 comprising an amino acid sequence set forth by SEQ ID NO: 568; and
a light chain variable region comprising:
(d) an LCDR1 comprising an amino acid sequence set forth by SEQ ID NO: 569;
(e) an LCDR2 comprising an amino acid sequence set forth by SEQ ID NO: 488; and
(f) an LCDR3 comprising an amino acid sequence set forth by any one of SEQ ID NO: 572.

520. An antibody or antigen-binding fragment that specifically binds to TL1A, comprising:
a heavy chain variable region comprising:
(a) an HCDR1 comprising an amino acid sequence set forth by SEQ ID NO: 553;
(b) an HCDR2 comprising an amino acid sequence set forth by SEQ ID NO: 555; and
(c) an HCDR3 comprising an amino acid sequence set forth by SEQ ID NO: 566; and
a light chain variable region comprising:
(d) an LCDR1 comprising an amino acid sequence set forth by SEQ ID NO: 569;
(e) an LCDR2 comprising an amino acid sequence set forth by SEQ ID NO: 488; and
(f) an LCDR3 comprising an amino acid sequence set forth by any one of SEQ ID NO: 572.

521. An antibody or antigen-binding fragment that specifically binds to TL1A, comprising:
a heavy chain variable region comprising:
(a) an HCDR1 comprising an amino acid sequence set forth by SEQ ID NO: 553;
(b) an HCDR2 comprising an amino acid sequence set forth by SEQ ID NO: 558; and
(c) an HCDR3 comprising an amino acid sequence set forth by SEQ ID NO: 566; and
a light chain variable region comprising:
(d) an LCDR1 comprising an amino acid sequence set forth by SEQ ID NO: 569;
(e) an LCDR2 comprising an amino acid sequence set forth by SEQ ID NO: 488; and (f) an LCDR3 comprising an amino acid sequence set forth by any one of SEQ ID NO: 572.
522. An antibody or antigen-binding fragment that specifically binds to TL1A, comprising:
a heavy chain variable region comprising:
(a) an HCDR1 comprising an amino acid sequence set forth by SEQ ID NO: 553;
(b) an HCDR2 comprising an amino acid sequence set forth by SEQ ID NO: 564; and
(c) an HCDR3 comprising an amino acid sequence set forth by SEQ ID NO: 568; and
a light chain variable region comprising:
(d) an LCDR1 comprising an amino acid sequence set forth by SEQ ID NO: 569;
(e) an LCDR2 comprising an amino acid sequence set forth by SEQ ID NO: 488; and
(f) an LCDR3 comprising an amino acid sequence set forth by any one of SEQ ID NO: 572.
523. An antibody or antigen-binding fragment that specifically binds to TL1A, comprising:
(a) a heavy chain variable region comprising an HCDR1, an HCDR2, and an HCDR3 from any one of SEQ ID NOs: 491, 493, 495, 497, 499, 501, 503, 505, 507, 509, 511, 513, 515, 517, 519, 521, 523, 525, 527, 529, 531, 533, 535, 537, 539, or 541; and
(b) a light chain variable region comprising an LCDR1, an LCDR2, and an LCDR3 from any one of SEQ ID NOs: 490, 492, 494, 496, 498, 500, 502, 504, 506, 508, 510, 512, 514, 516, 518, 520, 522, 524, 526, 528, 530, 532, 534, 536, 538, or 540;
wherein the CDRs are defined by the Kabat, Chothia, or IMGT method or a combination thereof.
524. The antibody or antigen-binding fragment of any one of embodiments 517 to 523, comprising a human heavy chain framework region 1 that is at least 90%, 95%, 96%, 97%, 98%, 99% identical to that set forth is SEQ ID NO: 545.
525. The antibody or antigen-binding fragment of any one of embodiments 517 to 524, comprising a human heavy chain framework region 2 that is at least 90%, 95%, 96%, 97%, 98%, 99% identical to that set forth is SEQ ID NO: 546.
526. The antibody or antigen-binding fragment of any one of embodiments 517 to 525, comprising a human heavy chain framework region 3 that is at least 90%, 95%, 96%, 97%, 98%, 99% identical to that set forth is SEQ ID NO: 547 or 586 to 588.
527. The antibody or antigen-binding fragment of any one of embodiments 517 to 526, comprising a human heavy chain framework region 4 that is at least 90%, 95%, 96%, 97%, 98%, 99% identical to that set forth is SEQ ID NO: 548.
528. The antibody or antigen-binding fragment of any one of embodiments 517 to 527, comprising a human light chain framework region 1 that is at least 90%, 95%, 96%, 97%, 98%, 99% identical to that set forth is SEQ ID NO: 549.
529. The antibody or antigen-binding fragment of any one of embodiments 517 to 528, comprising a human light chain framework region 2 that is at least 90%, 95%, 96%, 97%, 98%, 99% identical to that set forth is SEQ ID NO: 550.
530. The antibody or antigen-binding fragment of any one of embodiments 517 to 529, comprising a human light chain framework region 3 that is at least 90%, 95%, 96%, 97%, 98%, 99% identical to that set forth is SEQ ID NO: 551.
531. The antibody or antigen-binding fragment of any one of embodiments 517 to 530, comprising a human light chain framework region 4 that is at least 90%, 95%, 96%, 97%, 98%, 99% identical to that set forth is SEQ ID NO: 552.
532. The antibody or antigen-binding fragment of any one of embodiments 517 to 531, comprising:
(a) a human heavy chain framework region 1 that is at least 90% identical to that set forth is SEQ ID NO: 545;
(b) a human heavy chain framework region 2 that is at least 90% identical to that set forth is SEQ ID NO: 546;
(c) a human heavy chain framework region 3 that is at least 90% identical to that set forth is SEQ ID NO: 547 or 586 to 588;
(d) a human heavy chain framework region 4 that is at least 90% identical to that set forth is SEQ ID NO: 548;
(e) a human light chain framework region 1 that is at least 90% identical to that set forth is SEQ ID NO: 549;
(f) a human light chain framework region 2 that is at least 90% identical to that set forth is SEQ ID NO: 550;
(g) a human light chain framework region 3 that is at least 90% identical to that set forth is SEQ ID NO: 551; and
(h) a human light chain framework region 4 that is at least 90% identical to that set forth is SEQ ID NO: 552.
533. The antibody or antigen-binding fragment of embodiment 532, comprising:
(a) a human heavy chain framework region 1 that is at least 95% identical to that set forth is SEQ ID NO: 545;
(b) a human heavy chain framework region 2 that is at least 95% identical to that set forth is SEQ ID NO: 546;
(c) a human heavy chain framework region 3 that is at least 95% identical to that set forth is SEQ ID NO: 547 or 586 to 588;
(d) a human heavy chain framework region 4 that is at least 95% identical to that set forth is SEQ ID NO: 548;
(e) a human light chain framework region 1 that is at least 95% identical to that set forth is SEQ ID NO: 549;
(f) a human light chain framework region 2 that is at least 95% identical to that set forth is SEQ ID NO: 550;
(g) a human light chain framework region 3 that is at least 95% identical to that set forth is SEQ ID NO: 551; and
(h) a human light chain framework region 4 that is at least 95% identical to that set forth is SEQ ID NO: 552.
534. The antibody or antigen-binding fragment of embodiments 532, comprising:
(a) a human heavy chain framework region 1 that is at least 97% identical to that set forth is SEQ ID NO: 545;
(b) a human heavy chain framework region 2 that is at least 97% identical to that set forth is SEQ ID NO: 546;
(c) a human heavy chain framework region 3 that is at least 97% identical to that set forth is SEQ ID NO: 547 or 586 to 588;
(d) a human heavy chain framework region 4 that is at least 97% identical to that set forth is SEQ ID NO: 548;
(e) a human light chain framework region 1 that is at least 97% identical to that set forth is SEQ ID NO: 549;
(f) a human light chain framework region 2 that is at least 97% identical to that set forth is SEQ ID NO: 550;
(g) a human light chain framework region 3 that is at least 97% identical to that set forth is SEQ ID NO: 551; and
(h) a human light chain framework region 4 that is at least 97% identical to that set forth is SEQ ID NO: 552.
535. The antibody or antigen-binding fragment of embodiment 532, comprising:
(a) a human heavy chain framework region 1 that is at least 98% identical to that set forth is SEQ ID NO: 545;
(b) a human heavy chain framework region 2 that is at least 98% identical to that set forth is SEQ ID NO: 546;

(c) a human heavy chain framework region 3 that is at least 98% identical to that set forth is SEQ ID NO: 547 or 586 to 588;

(d) a human heavy chain framework region 4 that is at least 98% identical to that set forth is SEQ ID NO: 548;

(e) a human light chain framework region 1 that is at least 98% identical to that set forth is SEQ ID NO: 549;

(f) a human light chain framework region 2 that is at least 98% identical to that set forth is SEQ ID NO: 550;

(g) a human light chain framework region 3 that is at least 98% identical to that set forth is SEQ ID NO: 551; and (h) a human light chain framework region 4 that is at least 98% identical to that set forth is SEQ ID NO: 552.

536. An antibody or antigen-binding fragment that specifically binds to TL1A, comprising:

(a) a heavy chain variable region comprising an amino acid sequence at least about 85%, 90%, 95%, 97%, 98%, 99%, or 100% identical to any one of SEQ ID NOs: 491, 493, 495, 497, 499, 501, 503, 505, 507, 509, 511, 513, 515, 517, 519, 521, 523, 525, 527, 529, 531, 533, 535, 537, 539, or 541; and (b) a light chain variable region comprising an amino acid sequence at least about 85%, 90%, 95%, 97%, 98%, 99%, or 100% identical to any one of SEQ ID NOs: 490, 492, 494, 496, 498, 500, 502, 504, 506, 508, 510, 512, 514, 516, 518, 520, 522, 524, 526, 528, 530, 532, 534, 536, 538, or 540.

537. An antibody or antigen-binding fragment that specifically binds to TL1A, comprising:

(a) a heavy chain variable region comprising an amino acid sequence at least about 85%, 90%, 95%, 97%, 98%, 99%, or 100% identical to SEQ ID NO: 503; and (b) a light chain variable region comprising an amino acid sequence at least about 85%, 90%, 95%, 97%, 98%, 99%, or 100% identical to SEQ ID NO: 502.

538. An antibody or antigen-binding fragment that specifically binds to TL1A, comprising:

(a) a heavy chain variable region comprising an amino acid sequence at least about 85%, 90%, 95%, 97%, 98%, 99%, or 100% identical to SEQ ID NO: 511; and (b) a light chain variable region comprising an amino acid sequence at least about 85%, 90%, 95%, 97%, 98%, 99%, or 100% identical to SEQ ID NO: 510.

539. An antibody or antigen-binding fragment that specifically binds to TL1A, comprising:

(a) a heavy chain variable region comprising an amino acid sequence at least about 85%, 90%, 95%, 97%, 98%, 99%, or 100% identical to SEQ ID NO: 493; and (b) a light chain variable region comprising an amino acid sequence at least about 85%, 90%, 95%, 97%, 98%, 99%, or 100% identical to SEQ ID NO: 492.

540. An antibody or antigen-binding fragment that specifically binds to TL1A, comprising:

(a) a heavy chain variable region comprising an amino acid sequence at least about 85%, 90%, 95%, 97%, 98%, 99%, or 100% identical to SEQ ID NO: 501; and (b) a light chain variable region comprising an amino acid sequence at least about 85%, 90%, 95%, 97%, 98%, 99%, or 100% identical to SEQ ID NO: 500.

541. An antibody or antigen-binding fragment that specifically binds to TL1A, comprising:

(a) a heavy chain variable region comprising an amino acid sequence at least about 85%, 90%, 95%, 97%, 98%, 99%, or 100% identical to SEQ ID NO: 515; and (b) a light chain variable region comprising an amino acid sequence at least about 85%, 90%, 95%, 97%, 98%, 99%, or 100% identical to SEQ ID NO: 514.

542. The antibody or antigen-binding fragment of any one of embodiments 517 to 541, wherein the antibody or antigen-binding fragment is chimeric or humanized.

543. The antibody or antigen-binding fragment of any one of embodiments 517 to 541, wherein the antibody or antigen-binding fragment is an IgG antibody.

544. The antibody or antigen-binding fragment of any one of embodiments 517 to 541, wherein the antibody or antigen-binding fragment comprises a Fab, F(ab)$_2$, a single-domain antibody, a single chain variable fragment (scFv), or a nanobody.

545. The antibody or antigen-binding fragment of any one of embodiments 517 to 544, comprising a heavy chain constant region comprising an amino acid sequence as set forth by SEQ ID NO: 542 or 543.

546. The antibody or antigen-binding fragment of any one of embodiments 517 to 544, comprising a heavy chain constant region comprising an amino acid sequence as set forth by SEQ ID NO: 542.

547. The antibody or antigen-binding fragment of any one of embodiments 517 to 544, comprising a light chain constant region comprising an amino acid sequence as set forth by SEQ ID NO: 544.

In certain embodiments, the antibody or antigen binding fragment comprises (a) a heavy chain variable region comprising an amino acid sequence at least about 85%, 90%, 95%, 97%, 98%, 99%, or 100% identical to any one of SEQ ID NOs: 491, 493, 495, 497, 499, 501, 503, 505, 507, 509, 511, 513, 515, 517, 519, 521, 523, 525, 527, 529, 531, 533, 535, 537, 539, or 541; and (b) a light chain variable region comprising an amino acid sequence at least about 85%, 90%, 95%, 97%, 98%, 99%, or 100% identical to any one of SEQ ID NOs: 490, 492, 494, 496, 498, 500, 502, 504, 506, 508, 510, 512, 514, 516, 518, 520, 522, 524, 526, 528, 530, 532, 534, 536, 538, or 540.

Non-limiting methods for determining whether an anti-TL1A antibody binds to the same region of a reference antibody are known in the art. An exemplary method comprises a competition assay. For instance, the method comprises determining whether a reference antibody can compete with binding between the reference antibody and the TL1A protein or portion thereof, or determining whether the reference antibody can compete with binding between the reference antibody and the TL1A protein or portion thereof. Exemplary methods include use of surface plasmon resonance to evaluate whether an anti-TL1A antibody can compete with the binding between TL1A and another anti-TL1A antibody. In some cases, surface plasmon resonance is utilized in the competition assay.

TABLE 2A

Non-Limiting Examples of anti-TL1A and anti-DR3 Antibodies and Portions Thereof

| SEQ ID | Antibody Region | Sequence |
|---|---|---|
| 109 | HCDR1 | GFTFSTYG |
| 110 | HCDR2 | ISGTGRTT |
| 111 | HCDR3 | TKERGDYYYG VFDY |
| 112 | LCDR1 | QTISSW |
| 113 | LCDR2 | AAS |
| 114 | LCDR3 | QQYHRSWT |
| 115 | HC Variable | EVQLLESGGG LVQPGKSLRL SCAVSGFTFS TYGMNWVRQA PGKGLEWVSS ISGTGRTTYH ADSVQGRFTV SRDNSKNILY LQMNSLRADD TAVYFCTKER GDYYYGVFDY WGQGTLVTVS S |
| 116 | LC Variable | DIQMTQSPST LSASVGDRVT ITCRASQTIS SWLAWYQQTP EKAPKLLIYA ASNLQSGVPS RFSGSGSGTE FTLTISSLQP DDFATYYCQQ YHRSWTFGQG TKVEIT |
| 117 | HCDR1 | GFTFSSYW |
| 118 | HCDR2 | IKEDGSEK |
| 119 | HCDR3 | AREDYDSYYK YGMDV |
| 120 | LCDR1 | QSILYSSNNK NY |
| 121 | LCDR2 | WAS |
| 122 | LCDR3 | QQYYSTPFT |
| 123 | HC Variable | EVQLVESGGG LVQPGGSLRL SCAVSGFTFS SYWMSWVRQA PGKGLEWVAN IKEDGSEKNY VDSVKGRFTL SSDNAKNSLY LQMNSLRAED TAVYYCARED YDSYYKYGMD VWGQGTAVIV SS |
| 124 | LC Variable | DIVMTQSPDS LAVSLGERAT INCKSSQSIL YSSNNKNYLA WYQQKPGQPP KLLIYWASTR ESGVPDRFSG SGSGTDFTLT ISSLQAEDVS VYYCQQYYST PFTFGPGTKV DIK |
| 125 | HCDR1 | GGSFTGFY |
| 126 | HCDR2 | INHRGNT |
| 127 | HCDR3 | ASPFYDFWSG SDY |
| 128 | LCDR1 | QSLVHSDGNT Y |
| 129 | LCDR2 | MS |
| 130 | LCDR3 | MQATQFPLT |
| 131 | HC Variable | QVQLQQWGAG LLKPSETLSL TCAVYGGSFT GFYWSWIRQP PGKGLEWIGE INHRGNTNYN PSLKSRVTMS VDTSKNQFSL NMISVTAADT AMYFCASPFY DFWSGSDYWG QGTLVTVSS |
| 132 | LC Variable | DIMLTQTPLT SPVTLGQPAS ISCKSSQSLV HSDGNTYLSW LQQRPGQPPR LLFYKISNRF SGVPDRFSGS GAGTDFTLKI SRVEAEDVGV YYCMQATQFP LTFGGGTKVE IK |

TABLE 2A-continued

Non-Limiting Examples of anti-TL1A and anti-DR3 Antibodies and Portions Thereof

| SEQ ID | Antibody Region | Sequence |
|---|---|---|
| 133 | HCDR1 | GY(X1)F(X2)(X3)YGIS; X1 = P, S, D, Q, N; X2 = T, R; X3 = N, T, Y, H |
| 134 | HCDR2 | WIS(X1)YNG(X2)(X3)(X4)YA(X5)(X6)(X7)QG; X1 = T, P, S, A; X2 = N, G, V, K, A; X3 = T, K; X4 = H, N; X5 = Q, R; X6 = K, M; X7 = L, H |
| 135 | HCDR3 | ENYYGSG(X1)(X2)R GGMD(X3); X1 = S, A; X2 = Y, P; X3 = V, A, G |
| 136 | HCDR1 | GYDFTYYGIS |
| 137 | HCDR2 | WISTYNGNTH YARMLQG |
| 138 | HCDR3 | ENYYGSGAYR GGMDV |
| 139 | LCDR1 | RASQSVSSYL A |
| 140 | LCDR2 | DASNRAT |
| 141 | LCDR3 | QQRSNWPWT |
| 142 | HC Variable | QVQLVQSGAE VKKPGASVKV SCKASGYDFT YYGISWVRQA PGQGLEWMGW ISTYNGNTHY ARMLQGRVTM TTDTSTRTAY MELRSLRSDD TAVYYCAREN YYGSGAYRGG MDVWGQGTTV TVSS |
| 143 | LC Variable | EIVLTQSPAT LSLSPGERAT LSCRASQSVS SYLAWYQQKP GQAPRLLIYD ASNRATGIPA RFSGSGSGTD FTLTISSLEP EDFAVYYCQQ RSNWPWTFGQ GTKVEIK |
| 144 | HC | QVQLVQSGAE VKKPGASVKV SCKASGYDFT YYGISWVRQA PGQGLEWMGW ISTYNGNTHY ARMLQGRVTM TTDTSTRTAY MELRSLRSDD TAVYYCAREN YYGSGAYRGG MDVWGQGTTV TVSSASTKGP SVFPLAPSSK STSGGTAALG CLVKDYFPEP VTVSWNSGAL TSGVHTFPAV LQSSGLYSLS SVVTVPSSSL GTQTYICNVN HKPSNTKVDK KVEPKSCDKT HTCPPCPAPE AAGAPSVFLF PPKPKDTLMI SRTPEVTCVV VDVSHEDPEV KFNWYVDGVE VHNAKTKPRE EQYNSTYRVV SVLTVLHQDW LNGKEYKCKV SNKALPAPIE KTISKAKGQP REPQVYTLPP SREEMTKNQV SLTCLVKGFY PSDIAVEWES NGQPENNYKT TPPVLDSDGS FFLYSKLTVD KSRWQQGNVF SCSVMHEALH NHYTQKSLSL SPG |
| 145 | LC | EIVLTQSPAT LSLSPGERAT LSCRASQSVS SYLAWYQQKP GQAPRLLIYD ASNRATGIPA RFSGSGSGTD FTLTISSLEP EDFAVYYCQQ RSNWPWTFGQ GTKVEIKRTV AAPSVFIFPP SDEQLKSGTA SVVCLLNNFY PREAKVQWKV DNALQSGNSQ ESVTEQDSKD STYSLSSTLT LSKADYEKHK VYACEVTHQG LSSPVTKSFN RGEC |
| 146 | HCDR1 | SRSYYWG |
| 147 | HCDR2 | SIYYNGRTYY NPSLKS |
| 148 | HCDR3 | EDYGDYGAFD I |
| 149 | LCDR1 | RASQGISSAL A |
| 150 | LCDR2 | DASSLES |

TABLE 2A-continued

Non-Limiting Examples of anti-TL1A and anti-DR3 Antibodies and Portions Thereof

| SEQ ID | Antibody Region | Sequence |
|---|---|---|
| 151 | LCDR3 | QQFNSYPLT |
| 152 | HC Variable | QLQLQESGPG LVKPSETLSL TCTVSGGSIS SRSYYWGWIR QPPGKGLEWI GSIYYNGRTY YNPSLKSRVT ISVDTSKNQF SLKLSSVTAA DTAVYYCARE DYGDYGAFDI WGQGTMVTVS S |
| 153 | LC Variable | AIQLTQSPSS LSASVGDRVT ITCRASQGIS SALAWYQQKP GKAPKLLIYD ASSLESGVPS RFSGSGSGTD FTLTISSLQP EDFATYYCQQ FNSYPLTFGG GTKVEIK |
| 154 | HCDR1 | TSNMGVV |
| 155 | HCDR2 | HILWDDREYSNPALKS |
| 156 | HCDR3 | MSRNYYGSSYVMDY |
| 157 | LCDR1 | SASSSVNYMH |
| 158 | LCDR2 | STSNLAS |
| 159 | LCDR3 | HQWNNYGT |
| 160 | HC Variable | QVTLKESGPALVKPTQTLTLTCTFSGFSLSTSNMGVVWIRQPPGK ALEWLAHILWDD REYSNPALKSRLTISKDTSKNQVVLTMTNMDPVDTATYYCARM SRNYYGSSYVMD YWGQGTLVTVSS |
| 161 | LC Variable | DIQLTQSPSFLSASVGDRVTITCSASSSVNYMHWYQQKPGKAPK LLIYSTSNLASGVP SRFSGSGSGTEFTLTISSLQPEDFATYYCHQWNNYGTFGQGTKV EIKR |
| 162 | HCDR1 | LYGMN |
| 163 | HCDR1 | NYGMN |
| 164 | HCDR2 | WINTYTGEPTYADDFKG |
| 165 | HCDR3 | DTAMDYAMAY |
| 166 | HCDR3 | DYGKYGDYYAMDY |
| 167 | LCDR1 | KSSQNIVHSDGNTYLE |
| 168 | LCDR1 | RSSQSIVHSNGNTYLD |
| 169 | LCDR2 | KVSNRFS |
| 170 | LCDR3 | FQGSHVPLT |
| 171 | HC Variable | QVQLVQSGSELKKPGASVKVSCKASGYTFTLYGMNWVRQAPG QGLEWMG WINTYTGEPTYADDFKGRFVFSLDTSVSTAYLQISSLKAEDTAV YYCAR DTAMDYAMAYWGQGTLVTVSS |
| 172 | HC Variable | QVQLVQSGSELKKPGASVKVSCKASGYTFTLYGMNWVKQAPG KGLKWMG WINTYTGEPTYADDFKGRFVFSLDTSVSTAYLQISSLKAEDTAV YFCAR DTAMDYAMAYWGQGTLVTVSS |
| 173 | HC Variable | QVQLVQSGSELKKPGASVKVSCKASGYTFTNYGMNWVRQAPG QGLEWMG WINTYTGEPTYADDFKGRFVFSLDTSVSTAYLQISSLKAEDTAV YYCAR DYGKYGDYYAMDYWGQGTLVTVSS |
| 174 | HC Variable | QVQLVQSGSELKKPGASVKVSCKASGYTFTNYGMNWVRQAPG KGLKWMG WINTYTGEPTYADDFKGRFVFSLDTSVSTAYLQISSLKAEDTAV YFCAR DYGKYGDYYAMDYWGQGTLVTVSS |

TABLE 2A-continued

Non-Limiting Examples of anti-TL1A and anti-DR3 Antibodies and Portions Thereof

| SEQ ID | Antibody Region | Sequence |
|---|---|---|
| 175 | LC Variable | DVVMTQSPLSLPVTLGQPASISCKSSQNIVHSDGNTYLEWFQQRPGQSP RRLIYKVSNRFSGVPDRFSGSGSGTDFTLKISRVEAEDVGVYYCF QGSH VPLTFGGGTKVEIKR |
| 176 | LC Variable | DVVMTQSPLSLPVTLGQPASISCKSSQNIVHSDGNTYLEWFQQRPGQSP RRLIYKVSNRFSGVPDRFSGSGSGTDFTLKISRVEAEDVGVYYCF QGSH VPLTFGQGTKVEIKR |
| 177 | LC Variable | DVVMTQTPLSLPVTPGEPASISCKSSQNIVHSDGNTYLEWYLQKPGQSP QLLIYKVSNRFSGVPDRFSGSGSGTDFTLKISRVEAEDLGVYYCF QGSH VPLTFGGGTKVEIKR |
| 178 | LC Variable | DVVMTQTPLSLPVSLGDQASISCKSSQNIVHSDGNTYLEWYLQKPGQSP KVLIYKVSNRFSGVPDRFSGSGSGTDFTLKISRVEAEDLGVYYCF QGSH VPLTFGGGTKVEIKR |
| 179 | LC Variable | DVVMTQSPLSLPVTLGQPASISCRSSQSIVHSNGNTYLDWFQQRPGQSP RRLIYKVSNRFSGVPDRFSGSGSGTDFTLKISRVEAEDVGVYYCF QGSH VPLTFGGGTKVEIKR |
| 180 | LC Variable | DVVMTQSPLSLPVTLGQPASISCRSSQSIVHSNGNTYLDWFQQRPGQSP RRLIYKVSNRFSGVPDRFSGSGSGTDFTLKISRVEAEDVGVYYCF QGSH VPLTFGQGTKVEIKR |
| 181 | LC Variable | DVVMTQTPLSLPVTPGEPASISCRSSQSIVHSNGNTYLDWYLQKPGQSP QLLIYKVSNRFSGVPDRFSGSGSGTDFTLKISRVEAEDLGVYYCF QGSH VPLTFGGGTKVEIKR |
| 182 | LC Variable | DVVMTQTPLSLPVSLGDQASISCRSSQSIVHSNGNTYLDWYLQKPGQSP KVLIYKVSNRFSGVPDRFSGSGSGTDFTLKINRVEAEDLGVYFCF QGSH VPLTFGGGTKLEIKR |
| 183 | HCDR1 | GYTFTSSWMH |
| 184 | HCDR2 | IHPNSGGT |
| 185 | HCDR3 | ARGDYYGYVS WFAY |
| 186 | LCDR1 | QNINVL |
| 187 | LCDR2 | KAS |
| 188 | LCDR3 | QQGQSYPYT |
| 189 | HC Variable | QVQLQQPGSV LVRPGASVKV SCKASGYTFT SSWMHWAKQR PGQGLEWIGE IHPNSGGTNY NEKFKGKATV DTSSSTAYVD LSSLTSEDSA VYYCARGDYY GYVSWFAYWG QGTLVTVSS |
| 190 | HC Variable | QVQLVQSGAE VKKPGASVKV SCKASGYTFT SSWMHWARQA PGQGLEWIGE IHPNSGGTNY AQKFQGRATL TVDTSSSTAY MELSRLRSDD TAVYYCARGD YYGYVSWFAY WGQGTLVTVS S |
| 191 | HC Variable | QVQLVQSGAE VKKPGASVKV SCKASGYTFT SSWMHWARQA PGQGLEWIGE IHPNSGGTNY AQKFQGRATM TVDTSISTAY MELSRLRSDD TAVYYCARGD YYGYVSWFAY WGQGTLVTVS S |
| 192 | HC Variable | QVQLVQSGAE VKKPGASVKV SCKASGYTFT SSWMHWARQA PGQGLEWIGE IHPNSGGTNY AQKFQGRVTM TVDTSISTAY MELSRLRSDD |

TABLE 2A-continued

Non-Limiting Examples of anti-TL1A and anti-DR3 Antibodies and Portions Thereof

| SEQ ID | Antibody Region | Sequence |
|---|---|---|
| | | TAVYYCARGD YYGYVSWFAY WGQGTLVTVS S |
| 193 | HC Variable | QVQLVQSGAE VKKPGASVKV SCKASGYTFT SSWMHWARQA PGQGLEWMGE IHPNSGGTNY AQKFQGRVTM TVDTSISTAY MELSRLRSDD TAVYYCARGD YYGYVSWFAY WGQGTLVTVS S |
| 194 | LC Variable | DIQMNQSPSS LSASLGDTIT ITCHASQNIN VLLSWYQQKP GNIPKLLIYK ASNLHTGVPS RFSGSGSGTG FTFTISSLQP EDIATYYCQQ GQSYPYTFGG GTKLEIK |
| 195 | LC Variable | DIQMTQSPSS LSASVGDRVT ITCQASQDIS NYLNWYQQKP GKAPKLLIYD ASNLETGVPS RFSGSGSGTD FTFTISSLQP EDIATYYCQQ YDNLPYTFGQ GTKLEIK |
| 196 | LC Variable | DIQMTQSPSS LSASVGDRVT ITCQASQNIN VLLNWYQQKP GKAPKLLIYK ASNLHTGVPS RFSGSGSGTD FTFTISSLQP EDIATYYCQQ GQSYPYTFGQ GTKLEIK |
| 197 | LC Variable | DIQMNQSPSS LSASVGDRVT ITCQASQNIN VLLSWYQQKP GKAPKLLIYK ASNLHTGVPS RFSGSGSGTD FTFTISSLQP EDIATYYCQQ GQSYPYTFGQ GTKLEIK |
| 198 | HCDR1 | GYTFTSYDIN |
| 199 | HCDR2 | WLNPNSGXTG; X =N, Y |
| 200 | HCDR3 | EVPETAAFEY |
| 201 | LCDR1 | TSSSSDIGA(X1)(X2)GV(X3); X1 = G, A; X2 = L, S, Q; X3 = H, L |
| 202 | LCDR2 | GYYNRPS |
| 203 | LCDR3 | QSXDGTLSAL; X = Y, W, F |
| 204 | HC Variable | QVQLVQSGAE VKKPGASVKV SCKASGYTFT SYDINWVRQA PGQGLEWMGW LNPNSGNTGY AQKFQGRVTM TADRSTSTAY MELSSLRSED TAVYYCAREV PETAAFEYWG QGTLVTVSS |
| 205 | LC Variable | QSVLTQPPSV SGAPGQRVTI SCTSSSSDIG AXXGVXWYQQ LPGTAPKLLI EGYYNRPSGV PDRFSGSKSG TSASLTITGL LPEDEGDYYC QSXDGTLSAL FGGGTKLTVL G |
| 206 | HC Variable | QVQLVQSGAE VKKPGASVKV SCKASGYTFT SYDINWVRQA PGQGLEWMGW LNPNSGNTGY AQKFQGRVTM TADRSTSTAY MELSSLRSED TAVYYCAREV PETAAFEYWG QGTLVTVSS |
| 207 | LC Variable | QSVLTQPPSV SGAPGQRVTI SCTSSSSDIG AGLGVHWYQQ LPGTAPKLLI EGYYNRPSGV PDRFSGSKSG TSASLTITGL LPEDEGDYYC QSWDGTLSAL FGGGTKLTVL G |
| 208 | HC Variable | QVQLVQSGAE VKKPGASVKV SCKASGYTFT SYDINWVRQA PGQGLEWMGW |

TABLE 2A-continued

Non-Limiting Examples of anti-TL1A and anti-DR3 Antibodies and Portions Thereof

| SEQ ID | Antibody Region | Sequence |
|---|---|---|
| | | LNPNSGYTGY AQKFQGRVTM TADRSTSTAY MELSSLRSED TAVYYCAREV PETAAFEYWG QGTLVTVSS |
| 209 | LC Variable | QSVLTQPPSV SGAPGQRVTI SCTSSSSDIG AGLGVHWYQQ LPGTAPKLLI EGYYNRPSGV PDRFSGSKSG TSASLTITGL LPEDEGDYYC QSYDGTLSAL FGGGTKLTVL G |
| 210 | HC Variable | QVQLVQSGAE VKKPGASVKV SCKASGYTFT SYDINWVRQA PGQGLEWMGW LNPNSGNTGY AQKFQGRVTM TADRSTSTAY MELSSLRSED TAVYYCAREV PETAAFEYWG QGTLVTVSS |
| 211 | LC Variable | QSVLTQPPSV SGAPGQRVTI SCTSSSSDIG AALGVHWYQQ LPGTAPKLLI EGYYNRPSGV PDRFSGSKSG TSASLTITGL LPEDEGDYYC QSWDGTLSAL FGGGTKLTVL G |
| 212 | HC Variable | QVQLVQSGAE VKKPGASVKV SCKASGYTFT SYDINWVRQA PGQGLEWMGW LNPNSGNTGY AQKFQGRVTM TADRSTSTAY MELSSLRSED TAVYYCAREV PETAAFEYWG QGTLVTVSS |
| 213 | LC Variable | QSVLTQPPSV SGAPGQRVTI SCTSSSSDIG AGSGVHWYQQ LPGTAPKLLI EGYYNRPSGV PDRFSGSKSG TSASLTITGL LPEDEGDYYC QSWDGTLSAL FGGGTKLTVL G |
| 214 | HC Variable | QVQLVQSGAE VKKPGASVKV SCKASGYTFT SYDINWVRQA PGQGLEWMGW LNPNSGNTGY AQKFQGRVTM TADRSTSTAY MELSSLRSED TAVYYCAREV PETAAFEYWG QGTLVTVSS |
| 215 | LC Variable | QSVLTQPPSV SGAPGQRVTI SCTSSSSDIG AGQGVHWYQQ LPGTAPKLLI EGYYNRPSGV PDRFSGSKSG TSASLTITGL LPEDEGDYYC QSWDGTLSAL FGGGTKLTVL G |
| 216 | HC Variable | QVQLVQSGAE VKKPGASVKV SCKASGYTFT SYDINWVRQA PGQGLEWMGW LNPNSGNTGY AQKFQGRVTM TADRSTSTAY MELSSLRSED TAVYYCAREV PETAAFEYWG QGTLVTVSS |
| 217 | LC Variable | QSVLTQPPSV SGAPGQRVTI SCTSSSSDIG AGLGVLWYQQ LPGTAPKLLI EGYYNRPSGV PDRFSGSKSG TSASLTITGL LPEDEGDYYC QSWDGTLSAL FGGGTKLTVL G |
| 218 | HC Variable | QVQLVQSGAE VKKPGASVKV SCKASGYTFT SYDINWVRQA PGQGLEWMGW LNPNSGYTGY AQKFQGRVTM TADRSTSTAY MELSSLRSED TAVYYCAREV PETAAFEYWG QGTLVTVSS |
| 219 | LC Variable | QSVLTQPPSV SGAPGQRVTI SCTSSSSDIG AGLGVHWYQQ LPGTAPKLLI EGYYNRPSGV PDRFSGSKSG TSASLTITGL LPEDEGDYYC QSWDGTLSAL FGGGTKLTVL G |
| 220 | HC Variable | QVQLVQSGAE VKKPGASVKV SCKASGYTFT SYDINWVRQA PGQGLEWMGW |

TABLE 2A-continued

Non-Limiting Examples of anti-TL1A and anti-DR3 Antibodies and Portions Thereof

| SEQ ID | Antibody Region | Sequence |
|---|---|---|
| | | LNPNSGYTGY AQKFQGRVTM TADRSTSTAY MELSSLRSED TAVYYCAREV PETAAFEYWG QGTLVTVSS |
| 221 | LC Variable | QSVLTQPPSV SGAPGQRVTI SCTSSSSDIG AGSGVHWYQQ LPGTAPKLLI EGYYNRPSGV PDRFSGSKSG TSASLTITGL LPEDEGDYYC QSWDGTLSAL FGGGTKLTVL G |
| 222 | HC Variable | QVQLVQSGAE VKKPGASVKV SCKASGYTFT SYDINWVRQA PGQGLEWMGW LNPNSGYTGY AQKFQGRVTM TADRSTSTAY MELSSLRSED TAVYYCAREV PETAAFEYWG QGTLVTVSS |
| 223 | LC Variable | QSVLTQPPSV SGAPGQRVTI SCTSSSSDIG AGQGVHWYQQ LPGTAPKLLI EGYYNRPSGV PDRFSGSKSG TSASLTITGL LPEDEGDYYC QSWDGTLSAL FGGGTKLTVL G |
| 224 | HC Variable | QVQLVQSGAE VKKPGASVKV SCKASGYTFT SYDINWVRQA PGQGLEWMGW LNPNSGYTGY AQKFQGRVTM TADRSTSTAY MELSSLRSED TAVYYCAREV PETAAFEYWG QGTLVTVSS |
| 225 | LC Variable | QSVLTQPPSV SGAPGQRVTI SCTSSSSDIG AGLGVLWYQQ LPGTAPKLLI EGYYNRPSGV PDRFSGSKSG TSASLTITGL LPEDEGDYYC QSWDGTLSAL FGGGTKLTVL G |
| 226 | HC Variable | QVQLVQSGAE VKKPGASVKV SCKASGYTFT SYDINWVRQA PGQGLEWMGW LNPNSGYTGY AQKFQGRVTM TADRSTSTAY MELSSLRSED TAVYYCAREV PETAAFEYWG QGTLVTVSS |
| 227 | LC Variable | QSVLTQPPSV SGAPGQRVTI SCTSSSSDIG AGLGVHWYQQ LPGTAPKLLI EGYYNRPSGV PDRFSGSKSG TSASLTITGL LPEDEGDYYC QSFDGTLSAL FGGGTKLTVL G |
| 228 | HCDR1 | SYFWS |
| 229 | HCDR2 | YIYYSGNTKYNPSLKS |
| 230 | HCDR3 | ETGSYYGFDY |
| 231 | LCDR1 | RASQSINNYLN |
| 232 | LCDR2 | AASSLQS |
| 233 | LCDR3 | QQSYSTPRT |
| 234 | HC Variable | QVQLQESGPGLVKPSETLSLTCTVSGGSISSYFWSWIRQPPGKGL EWIGYIYYSGNTKYNPSLKSRVTISIDTSKNQFSLKLSSVTAADT AVYYCARETGSYYGFDYWGQGTLVTVSS |
| 235 | LC Variable | DIQMTQSPSSLSASVGDRVTITCRASQSINNYLNWYQQRPGKAP KLLIYAASSLQSGVPSRFSGSGSGTDFTLTISSLQPGDFATYYCQQ SYSTPRTFGQGTKLEIK |
| 236 | HCDR1 | GYYWN |
| 237 | HCDR2 | EINHAGNTNYNPSLKS |
| 238 | HCDR3 | GYCRSTTCYFDY |
| 239 | LCDR1 | RASQSVRSSYLA |

TABLE 2A-continued

Non-Limiting Examples of anti-TL1A and anti-DR3 Antibodies and Portions Thereof

| SEQ ID | Antibody Region | Sequence |
| --- | --- | --- |
| 240 | LCDR2 | GASSRAT |
| 241 | LCDR3 | QQYGSSPT |
| 242 | HC Variable | QVQLQQWGAGLLKPSETLSLTCAVHGGSFSGYYWNWIRQPPGK GLEWIGEINHAGNTNYNPSLKSRVTISLDTSKNQFSLTLTSVTAA DTAVYYCARGYCRSTTCYFDYWGQGTLVTVSS |
| 243 | LC Variable | EIVLTQSPGTLSLSPGERATLSCRASQSVRSSYLAWYQQKPGQAP RLLIYGASSRATGIPDRFSGSGSGTDFTLTISRLEPEDFAVYYCQQ YGSSPTFGQGTRLEIK |
| 244 | HC Variable | EVQLQQSGAELVKPGASVKLSCTASGFDIQDTYMHWVKQRPEQ GLEWIGRIDPASGHTKYDPKFQVKATITTDTSSNTAYLQLSSLTS EDTAVYYCSRSGGLPDVWGAGTTVTVSS |
| 245 | LC Variable | QIVLSQSPAILSASPGEKVTMTCRASSSVSYMYWYQQKPGSSPKP WIYATSNLASGVPDRFSGSGSGTSYSLTISRVEAEDAATYYCQQ WSGNPRTFGGGTKLEIK |
| 246 | HCDR1 | GFDIQDTYMH |
| 247 | HCDR2 | RIDPASGHTKYDPKFQV |
| 248 | HCDR3 | SGGLPDV |
| 249 | LCDR1 | RASSSVSYMY |
| 250 | LCDR2 | ATSNLAS |
| 251 | LCDR3 | QQWSGNPRT |
| 252 | HC Variable | QVQLVQSGAEVKKPGASVKLSCKASGFDIQDTYMHWVRQAPG QGLEWMGRIDPASGHTKYDPKFQVRVTMTTDTSTSTVYMELSS LRSEDTAVYYCSRSGGLPDVWGQGTTVTVSS |
| 253 | LC Variable | EIVLTQSPGTLSLSPGERVTMSCRASSSVSYMYWYQQKPGQAPR PWIYATSNLASGVPDRFSGSGSGTDYTLTISRLEPEDFAVYYCQQ WSGNPRTFGGGTKLEIK |
| 254 | (CDR-grafted LC) HC variable region | QVQLVQSGAEVKKPGASVKLSCKASGFDIQDTYMHWVRQAPG QGLEWMGRIDPASGHTKYDPKFQVRVTMTRDTSTSTVYMELSS LRSEDTAVYYCSRSGGLPDVWGQGTTVTVSS |
| 255 | (CDR-grafted LC) HC variable region | EIVLTQSPGTLSLSPGERATLSCRASSSVSYMYWYQQKPGQAPR LLIYATSNLASGIPDRFSGSGSGTDFTLTISRLEPEDFAVYYCQQW SGNPRTFGGGTKLEIK |
| 256 | (CDR-grafted HC) HC variable region | QVQLVQSGAEVKKPGASVKVSCKASGFDIQDTYMHWVRQAPG QGLEWMGRIDPASGHTKYDPKFQVRVTMTRDTSTSTVYMELSS LRSEDTAVYYCARSGGLPDVWGQGTTVTVSS |
| 257 | (CDR-grafted HC) LC variable region | EIVLTQSPGTLSLSPGERATLSCRASSSVSYMYWYQQKPGQAPR LLIYATSNLASGVPDRFSGSGSGTDYTLTISRLEPEDFAVYYCQQ WSGNPRTFGGGTKLEIK |
| 258 | HC variable | EVMLVESGGGLVKPGGSLKLSCAASGFTFTNYAMSWVRQTPEK RLEWVATITSGGSYIYYLDSVKGRFTISRDNAKSTLYLQMSSLRS EDTAIYNCARRKDGNYYYAMDYWGQGTSVTVSS |
| 259 | HC variable | EVMLVESGGGLVKPGGSLKLSCAASGFTFTNYAMSWVRQTPEK RLEWVATITSGGSYIYYLDSVKGRFTISRDNAKSTLYLQMSSLRS EDTAIYYCARRKDGNYYYAMDYWGQGTSVTVSS |
| 260 | HC variable | EVQLVESGGGLVKPGGSLRLSCAASGFTFTNYAMSWVRQAPGQ RLEWVSTITSGGSYIYYLDSVKGRFTISRDNAKSTLYLQMNSLRA EDTAVYNCARRKDGNYYYAMDYWGQGTTVTVSS |
| 261 | HC variable | EVQLVESGGGLVKPGGSLRLSCAASGFTFTNYAMSWVRQAPGQ RLEWVSTITSGGSYIYYLDSVKGRFTISRDNAKSTLYLQMNSLRA EDTAVYYCARRKDGNYYYAMDYWGQGTTVTVSS |

TABLE 2A-continued

Non-Limiting Examples of anti-TL1A and anti-DR3 Antibodies and Portions Thereof

| SEQ ID | Antibody Region | Sequence |
|---|---|---|
| 262 | HC variable | EVQLLESGGGLVQPGRSLRLSCAASGFTFTNYAMSWVRQAPGQ RLEWLATITSGGSYIYYLDSVKGRFTISRDNSKSTLYLQMGSLRA EDMAVYNCARRKDGNYYYAMDYWGQGTTVTVSS |
| 263 | HC variable | EVQLLESGGGLVQPGRSLRLSCAASGFTFTNYAMSWVRQAPGQ RLEWLATITSGGSYIYYLDSVKGRFTISRDNSKSTLYLQMGSLRA EDMAVYYCARRKDGNYYYAMDYWGQGTTVTVSS |
| 264 | HC variable | QVQLVESGGGLIQPGGSLRLSCAASGFTFTNYAMSWVRQARGQ RLEWVSTITSGGSYIYYLDSVKGRFTISRDNSKSTLYMELSSLRSE DTAVYNCARRKDGNYYYAMDYWGQGTTVTVSS |
| 265 | HC variable | QVQLVESGGGLIQPGGSLRLSCAASGFTFTNYAMSWVRQARGQ RLEWVSTITSGGSYIYYLDSVKGRFTISRDNSKSTLYMELSSLRSE DTAVYYCARRKDGNYYYAMDYWGQGTTVTVSS |
| 266 | HC variable | QVQLVQSGSELKKPGASVKVSCKASGFTFTNYAMSWVRQAPGK RLEWVSTITSGGSYIYYLDSVKGRFTISRENAKSTLYLQMNSLRT EDTALYNCARRKDGNYYYAMDYVVGQGTTVTVSS |
| 267 | HC variable | QVQLVQSGSELKKPGASVKVSCKASGFTFTNYAMSWVRQAPGK RLEWVATITSGGSYIYYLDSVKGRFTISRENAKSTLYLQMNSLRT EDTALYYCARRKDGNYYYAMDYVVGQGTTVTVSS |
| 268 | HC variable | EVQLLQSGAEVKKPGASVKVSCKASGFTFTNYAMSWVRQAPG QRLEWVATITSGGSYIYYLDSVKGRFTISRDNAKSTLHLQMNSL RAEDTAVYNCARRKDGNYYYAMDYWGQGTTVTVSS |
| 269 | HC variable | EVQLLQSGAEVKKPGASVKVSCKASGFTFTNYAMSWVRQAPG QRLEWVATITSGGSYIYYLDSVKGRFTISRDNAKSTLHLQMNSL RAEDTAIYYCARRKDGNYYYAMDYWGQGTTVTVSS |
| 270 | HC variable | EVMLLQSGAEVKKPGASVKVSCKASGFTFTNYAMSWVRQAPG QRLEWVATITSGGSYIYYLDSVKGRFTISRDNAKSTLHLQMNSL RAEDTAVYYCARRKDGNYYYAMDYWGQGTTVTVSS |
| 271 | LC variable | DIVLTQSPASLAVSLGQRATISCRASESVDSYGNSFIHWYQQKAG QPPKLLIYRASNLESGIPARFSGSGSRTDFTLTINPVEADDVATYY CQQSYEDPWTFGGGTKLEIK |
| 272 | LC variable | DIVLTQSPATLSLSPGERATLSCRASESVDSYGNSFIHWYQQKPG QPPKLLIYRASNLESGIPARFSGSGSRTDFTLTISSLEPEDFAVYYC QQSYEDPWTFGGGTKXEIK |
| 273 | LC variable | DIVLTQSPSSLSASVGDRVTITCRASESVDSYGNSFIHWYQQKPG QPPKLLIYRASNLESGIPARFSGSGSRTDFTLTISSLQPEDFATYYC QQSYEDPWTFGGGTKXEIK |
| 274 | LC variable | DIVLTQSPDFQSVTPKEKVTITCRASESVDSYGNSFIHWYQQKPG QPPKLLIYRASNLESGIPARFSGSGSRTDFTLTISSLEAEDAATYY CQQSYEDPWTFGGGTKXEIK |
| 275 | LC variable | DIVLTQTPLSLSVTPGQPASISCRASESVDSYGNSFIHWYQQKPG QPPKLLIYRASNLESGIPARFSGSGSRTDFTLKISRVEAEDVGVYY CQQSYEDPWTFGGGTKXEIK |
| 276 | HCDR1 | TYGMS |
| 277 | HCDR2 | WMNTYSGVTTYADDFKG |
| 278 | HCDR3 | EGYVFDDYYATDY |
| 279 | LCDR1 | RSSQNIVHSDGNTYLE |
| 280 | LCDR2 | KVSNRFS |
| 281 | LCDR3 | FQGSHVPLT |
| 282 | HC Variable | QIQLVQSGPELKKPGETVKISCKASGYTFTTYGMSWVKQAPGKG LKWMGWMNTYSGVTTYADDFKGRFAFSLETSASTAYMQIDNL KNEDTATYFCAREGYVFDDYYATDYWGQGTSVTVSS |

TABLE 2A-continued

Non-Limiting Examples of anti-TL1A and anti-DR3 Antibodies and Portions Thereof

| SEQ ID | Antibody Region | Sequence |
|---|---|---|
| 283 | LC Variable | DVLMTQTPLSLPVSLGDQASISCRSSQNIVHSDGNTYLEWYLQKPGQSPKLLIYKVSNRFSGVPDRFSGSGSGTDFTLKISRVEAEDLGIYYCFQGSHVPLTFGAGTKLELK |
| 284 | HCDR1 | KYDIN |
| 285 | HCDR2 | WIFPGDGRTDYNEKFKG |
| 286 | HCDR3 | YGPAMDY |
| 287 | LCDR1 | RSSQTIVHSNGDTYLD |
| 288 | LCDR2 | KVSNRFS |
| 289 | LCDR3 | FQGSHVPYT |
| 290 | HC Variable | MGWSWVFLFLLSVTAGVHSQVHLQQSGPELVKPGASVKLSCKASGYTFTKYDINWVRQRPEQGLEWIGWIFPGDGRTDYNEKFKGKATLTTDKSSSTAYMEVSRLTSEDSAVYFCARYGPAMDYWGQGTSVTVAS |
| 291 | LC Variable | MKLPVRLLVLMFWIPASSSDVLMTQTPLSLPVSLGDQASISCRSSQTIVHSNGDTYLDWFLQKPGQSPKLLIYKVSNRFSGVPDRFSGSGSGTDFTLKISRVEAEDLGVYYCFQGSHVPYTFGGGTKLEIK |
| 484 | HCDR1 | DTYMH |
| 485 | HCDR2 | PASGH |
| 486 | HCDR3 | SGGLPD |
| 487 | LCDR1 | ASSSVSYMY |
| 488 | LCDR2 | ATSNLAS |
| 489 | LCDR3 | GNPRT |
| 490 | VL | EIVLTQSPGTLSLSPGERATLSCRASSSVSYMYWYQQKPGQAPRLLIYATSNLASGIPDRFSGSGSGTDFTLTISRLEPEDFAVYYCQQWSGNPRTFGGGTKLEIK |
| 491 | VH | QVQLVQSGAEVKKPGASVKVSCKASGFDIQDTYMHWVRQAPGQGLEWMGRIDPASGHTKYDPKFQVRVTMTRDTSTSTVYMELSSLRSEDTAVYYCARSGGLPDVWGQGTTVTVSS |
| 492 | VL | EIVLTQSPGTLSLSPGERATLSCRASSSVSYMYWYQQKPGQAPRLLIYATSNLASGIPDRFSGSGSGTDFTLTISRLEPEDFAVYYCQQWEGNPRTFGGGTKLEIK |
| 493 | VH | QVQLVQSGAEVKKPGASVKVSCKASGFDIQDTYMHWVRQAPGQGLEWMGRIEPASGHIKYDPKFQGRVTMTRDTSTSTVYMELSSLRSEDTAVYYCARSGGLPDWWGQGTTVTVSS |
| 494 | VL | EIVLTQSPGTLSLSPGERATLSCRASSSVSYMYWYQQKPGQAPRLLIYATSNLASGIPDRFSGSGSGTDFTLTISRLEPEDFAVYYCQQWEGNPRTFGGGTKLEIK |
| 495 | VH | QVQLVQSGAEVKKPGASVKVSCKASGFDIQDTYMHWVRQAPGQGLEWMGRIEPASGHIKYSPKFQGRVTMTRDTSTSTVYMELSSLRSEDTAVYYCARSGGLPDWWGQGTTVTVSS |
| 496 | VL | EIVLTQSPGTLSLSPGERATLSCGASSSVSYMYWYQQKPGQAPRLLIYATSNLASGIPDRFSGSGSGTDFTLTISRLEPEDFAVYYCQQWEGNPRTFGGGTKLEIK |
| 497 | VH | QVQLVQSGAEVKKPGASVKVSCKASGFDIQDTYMHWVRQAPGQGLEWMGRIEPASGHIKYSPKFQGRVTMTRDTSTSTVYMELSSLRSEDTAVYYCARSGGLPDWWGQGTTVTVSS |
| 498 | VL | EIVLTQSPGTLSLSPGERATLSCRASSSVSYMYWYQQKPGQAPRLLIYATSNLASGIPDRFSGSGSGTDFTLTISRLEPEDFAVYYCQQWEGNPRTFGGGTKLEIK |

TABLE 2A-continued

Non-Limiting Examples of anti-TL1A and anti-DR3 Antibodies and Portions Thereof

| SEQ ID | Antibody Region | Sequence |
|---|---|---|
| 499 | VH | QVQLVQSGAEVKKPGASVKVSCKASGFDIQDTYMHWVRQAPGQGLEWMGRIEPASGHVKYSPKFQVRVTMTRDTSTSTVYMELSSLRSEDTAVYYCARSGGLPDWWGQGTTVTVSS |
| 500 | VL | EIVLTQSPGTLSLSPGERATLSCRASSSVSYMYWYQQKPGQAPRLLIYATSNLASGIPDRFSGSGSGTDFTLTISRLEPEDFAVYYCQQWEGNPRTFGGGTKLEIK |
| 501 | VH | QVQLVQSGAEVKKPGASVKVSCKASGFDIQDTYMHWVRQAPGQGLEWMGRIEPASGHVKYDPKFQTRVTMTRDTSTSTVYMELSSLRSEDTAVYYCARSGGLPDWWGQGTTVTVSS |
| 502 | VL | EIVLTQSPGTLSLSPGERATLSCRASSSVSYMYWYQQKPGQAPRLLIYATSNLASGIPDRFSGSGSGTDFTLTISRLEPEDFAVYYCQQWQGNPRTFGGGTKLEIK |
| 503 | VH | QVQLVQSGAEVKKPGASVKVSCKASGFDIQDTYMHWVRQAPGQGLEWMGRIDPASGHiKYDPKFQkRVTMTRDTSTSTVYMELSSLRSEDTAVYYCARSGGLPDMWGQGTTVTVSS |
| 504 | VL | EIVLTQSPGTLSLSPGERATLSCRASSSVSYMYWYQQKPGQAPRLLIYATSNLASGIPDRFSGSGSGTDFTLTISRLEPEDFAVYYCQQWQGNPRTFGGGTKLEIK |
| 505 | VH | QVQLVQSGAEVKKPGASVKVSCKASGFDIQDTYMHWVRQAPGQGLEWMGRIDPASGHvKiDPKFQVRVTMTRDTSTSTVYMELSSLRSEDTAVYYCARSGGLPDMWGQGTTVTVSS |
| 506 | VL | EIVLTQSPGTLSLSPGERATLSCRASSSVSYMYWYQQKPGQAPRLLIYATSNLASGIPDRFSGSGSGTDFTLTISRLEPEDFAVYYCQQWQGNPRTFGGGTKLEIK |
| 507 | VH | QVQLVQSGAEVKKPGASVKVSCKASGFDIQDTYMHWVRQAPGQGLEWMGRIDPASGHLKYDPKFQVRVTMTRDTSTSTVYMELSSLRSEDTAVYYCARSGGLPDMWGQGTTVTVSS |
| 508 | VL | EIVLTQSPGTLSLSPGERATLSCRASSSVSYMYWYQQKPGQAPRLLIYATSNLASGIPDRFSGSGSGTDFTLTISRLEPEDFAVYYCQQWQGNPRTFGGGTKLEIK |
| 509 | VH | QVQLVQSGAEVKKPGASVKVSCKASGFDIQDTYMHWVRQAPGQGLEWMGRIDPASGHLKYDPKFQRRVTMTRDTSTSTVYMELSSLRSEDTAVYYCARSGGLPDMWGQGTTVTVSS |
| 510 | VL | EIVLTQSPGTLSLSPGERATLSCRASSSVSYMYWYQQKPGQAPRLLIYATSNLASGIPDRFSGSGSGTDFTLTISRLEPEDFAVYYCQQWEGNPRTFGGGTKLEIK |
| 511 | VH | QVQLVQSGAEVKKPGASVKVSCKASGFDIQDTYMHWVRQAPGQGLEWMGRIDPASGHLKYDPKFQNRVTMTRDTSTSTVYMELSSLRSEDTAVYYCARSGGLPDKWGQGTTVTVSS |
| 512 | VL | EIVLTQSPGTLSLSPGERATLSCGASSSVSYMYWYQQKPGQAPRLLIYATSNLASGIPDRFSGSGSGTDFTLTISRLEPEDFAVYYCQQWEGNPRTFGGGTKLEIK |
| 513 | VH | QVQLVQSGAEVKKPGASVKVSCKASGFDIQDTYMHWVRQAPGQGLEWMGRIDPASGHLKYDPKFQNRVTMTRDTSTSTVYMELSSLRSEDTAVYYCARSGGLPDKWGQGTTVTVSS |
| 514 | VL | EIVLTQSPGTLSLSPGERATLSCRASSSVSYMYWYQQKPGQAPRLLIYATSNLASGIPDRFSGSGSGTDFTLTISRLEPEDFAVYYCQQWEGNPRTFGGGTKLEIK |
| 515 | VH | QVQLVQSGAEVKKPGASVKVSCKASGFDIQDTYMHWVRQAPGQGLEWMGRIEPASGHLKYDPKFQERVTMTRDTSTSTVYMELSSLRSEDTAVYYCARSGGLPDKWGQGTTVTVSS |
| 516 | VL | EIVLTQSPGTLSLSPGERATLSCGASSSVSYMYWYQQKPGQAPRLLIYATSNLASGIPDRFSGSGSGTDFTLTISRLEPEDFAVYYCQQWEGNPRTFGGGTKLEIK |

TABLE 2A-continued

Non-Limiting Examples of anti-TL1A and anti-DR3 Antibodies and Portions Thereof

| SEQ ID | Antibody Region | Sequence |
|---|---|---|
| 517 | VH | QVQLVQSGAEVKKPGASVKVSCKASGFDIQDTYMHWVRQAPG QGLEWMGRIEPASGHLKYDPKFQERVTMTRDTSTSTVYMELSS LRSEDTAVYYCARSGGLPDKWGQGTTVTVSS |
| 518 | VL | EIVLTQSPGTLSLSPGERATLSCRASSSVSYMYWYQQKPGQAPR LLIYATSNLASGIPDRFSGSGSGTDFTLTISRLEPEDFAVYYCQQW QGNPRTFGGGTKLEIK |
| 519 | VH | QVQLVQSGAEVKKPGASVKVSCKASGFDIQDTYMHWVRQAPG QGLEWMGRIDPASGHLKYDPKFQGRVTITRDTSASTAYMELSSL RSEDTAVYYCARSGGLPDMWGQGTTVTVSS |
| 520 | VL | EIVLTQSPGTLSLSPGERATLSCRASSSVSYMYWYQQKPGQAPR LLIYATSNLASGIPDRFSGSGSGTDFTLTISRLEPEDFAVYYCQQW QGNPRTFGGGTKLEIK |
| 521 | VH | QVQLVQSGAEVKKPGASVKVSCKASGFDIQDTYMHWVRQAPG QGLEWMGRIDPASGHLKYDPKFQGRVTITRDTSASTVYMELSSL RSEDTAVYYCARSGGLPDMWGQGTTVTVSS |
| 522 | VL | EIVLTQSPGTLSLSPGERATLSCRASSSVSYMYWYQQKPGQAPR LLIYATSNLASGIPDRFSGSGSGTDFTLTISRLEPEDFAVYYCQQW SGNPRTFGGGTKLEIK |
| 523 | VH | QVQLVQSGAEVKKPGASVKVSCKASGFDIQDTYMHWVRQAPG QGLEWMGRIDPASGHTKYDPKFQGRATITTDTSASTAYLQLSSL RSEDTAVYYCARSGGLPDVWGQGTTVTVSS |
| 524 | VL | EIVLTQSPGTLSLSPGERATLSCRASSSVSYMYWYQQKPGQAPR LLIYATSNLASGIPDRFSGSGSGTDFTLTISRLEPEDFAVYYCQQW SGNPRTFGGGTKLEIK |
| 525 | VH | QVQLVQSGAEVKKPGASVKVSCKASGFDIQDTYMHWVRQAPG QGLEWMGRIDPASGHTKYDPKFQVRATITTDTSASTAYLQLSSL RSEDTAVYYCARSGGLPDFWGQGTTVTVSS |
| 526 | VL | EIVLTQSPGTLSLSPGERATLSCRASSSVSYMYWYQQKPGQAPR LLIYATSNLASGIPDRFSGSGSGTDFTLTISRLEPEDFAVYYCQQW SGNPRTFGGGTKLEIK |
| 527 | VH | QVQLVQSGAEVKKPGASVKVSCKASGFDIQDTYMHWVRQAPG QGLEWMGRIDPASGHTKYDPKFQGRATITTDTSASTAYLQLSSL RSEDTAVYYCARSGGLPDFWGQGTTVTVSS |
| 528 | VL | EIVLTQSPGTLSLSPGERATLSCRASSSVSYMYWYQQKPGQAPR LLIYATSNLASGIPDRFSGSGSGTDFTLTISRLEPEDFAVYYCQQW SGNPRTFGGGTKLEIK |
| 529 | VH | QVQLVQSGAEVKKPGASVKVSCKASGFDIQDTYMHWVRQAPG QGLEWMGRIDPASGHTKYDPKFQGRATITTDTSASTAYLQLSSL RSEDTAVYYCARSGGLPDLWGQGTTVTVSS |
| 530 | VL | EIVLTQSPGTLSLSPGERATLSCRASSSVSYMYWYQQKPGQAPR LLIYATSNLASGIPDRFSGSGSGTDFTLTISRLEPEDFAVYYCSQW SGNPRTFGGGTKLEIK |
| 531 | VH | QVQLVQSGAEVKKPGASVKVSCKASGFDIQDTYMHWVRQAPG QGLEWMGRIDPASGHTKYDPKFQGRATITTDTSASTAYLQLSSL RSEDTAVYYCARSGGLPDFWGQGTTVTVSS |
| 532 | VL | EIVLTQSPGTLSLSPGERATLSCRASSSVSYMYWYQQKPGQAPR LLIYATSNLASGIPDRFSGSGSGTDFTLTISRLEPEDFAVYYCQQW SGNPRSFGGGTKLEIK |
| 533 | VH | QVQLVQSGAEVKKPGASVKVSCKASGFDIQDTYMHWVRQAPG QGLEWMGRIDPASGHTKYDPKFQGRATITTDTSASTAYLQLSSL RSEDTAVYYCARSGGLPDFWGQGTTVTVSS |
| 534 | VL | EIVLTQSPGTLSLSPGERATLSCRASSSVSYMYWYQQKPGQAPR LLIYATSNLASGIPDRFSGSGSGTDFTLTISRLEPEDFAVYYCQQW SRNPRTFGGGTKLEIK |

TABLE 2A-continued

Non-Limiting Examples of anti-TL1A and anti-DR3 Antibodies and Portions Thereof

| SEQ ID | Antibody Region | Sequence |
|---|---|---|
| 535 | VH | QVQLVQSGAEVKKPGASVKVSCKASGFDIQDTYMHWVRQAPGQGLEWMGRIDPASGHTKYDPKFQGRATITTDTSASTAYLQLSSLRSEDTAVYYCARSGGLPDFWGQGTTVTVSS |
| 536 | VL | EIVLTQSPGTLSLSPGERATLSCRASSSVSYMYWYQQKPGQAPRLLIYATSNLASGIPDRFSGSGSGTDFTLTISRLEPEDFAVYYCQQWKGNPRTFGGGTKLEIK |
| 537 | VH | QVQLVQSGAEVKKPGASVKVSCKASGFDIQDTYMHWVRQAPGQGLEWMGRIDPASGHTKYDPKFQGRATITTDTSASTAYLQLSSLRSEDTAVYYCARSGGLPDFWGQGTTVTVSS |
| 538 | VL | EIVLTQSPGTLSLSPGERATLSCRASSSVSYMYWYQQKPGQAPRLLIYATSNLASGIPDRFSGSGSGTDFTLTISRLEPEDFAVYYCQQWSGNPRTFGGGTKLEIK |
| 539 | VH | QVQLVQSGAEVKKPGASVKVSCKASGFDIQDTYMHWVRQAPGQGLEWMGRIDPASGHSKYDPKFQVRATITTDTSASTAYLQLSSLRSEDTAVYYCARSGGLPDFWGQGTTVTVSS |
| 540 | VL | EIVLTQSPGTLSLSPGERATLSCRASSSVSYMYWYQQKPGQAPRLLIYATSNLASGIPDRFSGSGSGTDFTLTISRLEPEDFAVYYCQQWSGNPRTFGGGTKLEIK |
| 541 | VH | QVQLVQSGAEVKKPGASVKVSCKASGFDIQDTYMHWVRQAPGQGLEWMGRIDPASGHYKYDPKFQVRATITTDTSASTAYLQLSSLRSEDTAVYYCARSGGLPDFWGQGTTVTVSS |
| 542 | Modified IgG1-Constant region | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK |
| 543 | IgG2 constant region | ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK |
| 544 | Kappa constant region | RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 545 | HFR1 | QVQLVQSGAEVKKPGASVKVSCKAS |
| 546 | HFR2 | WVRQAPGQGLEWMG |
| 547 | HFR3 | RVTMTRDTSTSTVYMELSSLRSEDTAVYYC |
| 548 | HFR4 | WGQGTTVTVSS |
| 549 | LFR1 | EIVLTQSPGTLSLSPGERATLSC |
| 550 | LFR2 | WYQQKPGQAPRLLIY |
| 551 | LFR3 | GIPDRFSGSGSGTDFTLTISRLEPEDFAVYYC |
| 552 | LFR4 | FGGGTKLEIK |
| 553 | HCDR1 | GFDIQDTYMH |
| 554 | HCDR2 | RIDPASGHTKYDPKFQV |
| 555 | HCDR2 | RIEPASGHIKYDPKFQG |
| 556 | HCDR2 | RIEPASGHIKYSPKFQG |

TABLE 2A-continued

Non-Limiting Examples of anti-TL1A and anti-DR3 Antibodies and Portions Thereof

| SEQ ID | Antibody Region | Sequence |
|---|---|---|
| 557 | HCDR2 | RIEPASGHVKYSPKFQV |
| 558 | HCDR2 | RIEPASGHVKYDPKFQT |
| 559 | HCDR2 | RIDPASGHIKYDPKFQK |
| 560 | HCDR2 | RIDPASGHVKIDPKFQV |
| 561 | HCDR2 | RIDPASGHLKYDPKFQV |
| 562 | HCDR2 | RIDPASGHLKYDPKFQR |
| 563 | HCDR2 | RIDPASGHLKYDPKFQN |
| 564 | HCDR2 | RIEPASGHLKYDPKFQE |
| 565 | HCDR3 | ARSGGLPDV |
| 566 | HCDR3 | ARSGGLPDW |
| 567 | HCDR3 | ARSGGLPDM |
| 568 | HCDR3 | ARSGGLPDK |
| 569 | LCDR1 | RASSSVSYMY |
| 570 | LCDR1 | GASSSVSYMY |
| 571 | LCDR3 | QQWSGNPRT |
| 572 | LCDR3 | QQWEGNPRT |
| 573 | LCDR3 | QQWQGNPRT |
| 574 | HCDR2 | RIDPASGHLKYDPKFQG |
| 575 | HCDR2 | RIDPASGHTKYDPKFQG |
| 576 | HCDR2 | RIDPASGHSKYDPKFQV |
| 577 | HCDR2 | RIDPASGHYKYDPKFQV |
| 578 | HCDR3 | ARSGGLPDV |
| 579 | HCDR3 | ARSGGLPDM |
| 580 | HCDR3 | ARSGGLPDF |
| 581 | HCDR3 | ARSGGLPDL |
| 582 | LCDR3 | SQWSGNPRT |
| 583 | LCDR3 | QQWSGNPRS |
| 584 | LCDR3 | QQWSRNPRT |
| 585 | LCDR3 | QQWKGNPRT |
| 586 | HFR3 | RATITTDTSASTAYLQLSSLRSEDTAVYYC |
| 587 | HFR3 | RVTITRDTSASTVYMELSSLRSEDTAVYYC |
| 588 | HFR3 | RVTITRDTSASTAYMELSSLRSEDTAVYYC |
| 1001 | HC Variable | GAAGTTCAGCTGCAACAGTCTGGCGCCGAGCTGGTTAAGCCT GGCGCTTCTGTGAAGCTGAGCTGTACCGCCTCTGGCTTCGACA TCCAAGACACCTACATGCACTGGGTCAAGCAGAGGCCTGAGC AGGGACTCGAGTGGATCGGCAGAATTGATCCTGCCAGCGGCC ACACCAAATACGACCCCAAGTTCCAAGTGAAGGCCACCATCA CCACCGACACCAGCAGCAATACCGCCTACCTGCAGCTGAGCA GCCTGACCTCTGAAGATACCGCCGTGTACTACTGCAGCAGAT CTGGCGGACTGCCCGATGTTTGGGGAGCCGGAACAACCGTGA CAGTGTCCAGC |

TABLE 2A-continued

Non-Limiting Examples of anti-TL1A and anti-DR3 Antibodies and Portions Thereof

| SEQ ID | Antibody Region | Sequence |
|---|---|---|
| 1002 | HC Variable | GAGGTTCAACTTCAACAATCGGGGGCCGAGCTGGTTAAGCCC GGCGCTTCTGTAAAATTGTCTTGCACTGCCTCTGGGTTTGACA TCCAAGATACATATATGCATTGGGTGAAACAGCGTCCCGAGC AGGGCTTGGAGTGGATTGGACGTATTGACCCCGCCTCTGGGC ACACGAAATATGATCCTAAGTTCCAGGTTAAAGCGACTATCA CAACGGACACCTCCAGCAATACGGCTTATTTACAGTTATCCTC GCTGACCTCTGAGGATACTGCAGTGTACTACTGCTCTCGCTCT GGTGGTCTGCCAGACGTGTGGGGTGCAGGAACTACAGTTACT GTGTCTTCA |
| 1003 | HC Variable | EVQLQQSGAELVKPGASVKLSCTASGFDIQDTYMHWVKQRPEQ GLEWIGRIDPASGHTKYDPKFQVKATITTDTSSNTAYLQLSSLTS EDTAVYYCSRSGGLPDVWGAGTTVTVSS |
| 1004 | LC Variable | CAAATTGTGCTGTCTCAGAGCCCCGCCATCCTGAGTGCTTCTC CAGGCGAGAAAGTGACCATGACCTGCAGAGCCAGCAGCAGC GTGTCCTACATGTACTGGTATCAGCAGAAGCCCGGCAGCAGC CCCAAGCCTTGGATCTACGCCACAAGCAATCTGGCCAGCGGC GTGCCCGATAGATTTTCTGGCTCTGGCAGCGGCACCAGCTAC AGCCTGACAATCTCTAGAGTGGAAGCCGAGGATGCCGCCACC TACTACTGTCAACAGTGGAGCGGCAACCCCAGAACCTTTGGC GGAGGCACCAAGCTGGAAATCAAG |
| 1005 | LC Variable | CAAATCGTCCTGTCACAGTCCCCGGCGATCCTTTCTGCTTCAC CAGGAGAGAAGGTAACCATGACATGTCGCGCCTCTTCCTCAG TTTCTTACATGTACTGGTACCAGCAGAAACCAGGATCATCTCC CAAACCCTGGATCTACGCTACATCAAACCTTGCATCTGGCGT GCCAGACCGTTTTTCAGGGTCGGGCTCGGGGACTTCCTATTCA TTAACCATTTCTCGCGTAGAAGCGGAAGACGCCGCCACGTAT TATTGTCAGCAGTGGTCAGGAAATCCGCGCACATTCGGAGGC GGAACGAAATTGGAGATCAAA |
| 1006 | LC Variable | QIVLSQSPAILSASPGEKVTMTCRASSSVSYMYWYQQKPGSSPKP WIYATSNLASGVPDRFSGSGSGTSYSLTISRVEAEDAATYYCQQ WSGNPRTFGGGTKLEIK |
| 1007 | HCDR1 | GGCTTCGACATCCAAGACACCTACATGCAC |
| 1008 | HCDR1 | GGGTTTGACATCCAAGATACATATATGCAT |
| 1009 | HCDR1 | GFDIQDTYMH |
| 10010 | HCDR2 | AGAATTGATCCTGCCAGCGGCCACACCAAATACGACCCCAAG TTCCAAGTG |
| 10011 | HCDR2 | CGTATTGACCCCGCCTCTGGGCACACGAAATATGATCCTAAG TTCCAGGTT |
| 10012 | HCDR2 | RIDPASGHTKYDPKFQV |
| 10013 | HCDR3 | TCTGGCGGACTGCCCGATGTT |
| 10014 | HCDR3 | TCTGGTGGTCTGCCAGACGTG |
| 10015 | HCDR3 | SGGLPDV |
| 10016 | LCDR1 | AGAGCCAGCAGCAGCGTGTCCTACATGTAC |
| 10017 | LCDR1 | CGCGCCTCTTCCTCAGTTTCTTACATGTAC |
| 10018 | LCDR1 | RASSSVSYMY |
| 10019 | LCDR2 | GCCACAAGCAATCTGGCCAGC |
| 10020 | LCDR2 | GCTACATCAAACCTTGCATCT |
| 10021 | LCDR2 | ATSNLAS |
| 10022 | LCDR3 | CAACAGTGGAGCGGCAACCCCAGAACC |
| 10023 | LCDR3 | CAGCAGTGGTCAGGAAATCCGCGCACA |
| 10024 | LCDR3 | QQWSGNPRT |

TABLE 2A-continued

Non-Limiting Examples of anti-TL1A and anti-DR3 Antibodies and Portions Thereof

| SEQ ID | Antibody Region | Sequence |
|---|---|---|
| 10025 | HC Variable | CAAGTACAATTAGTCCAGTCGGGTGCCGAGGTAAAAAAACCT<br>GGAGCATCCGTAAAACTGTCTTGCAAAGCATCGGGGTTTGAC<br>ATCCAGGACACCTACATGCACTGGGTGCGTCAAGCTCCAGGA<br>CAGGGATTAGAGTGGATGGGTCGCATCGACCCCGCGAGCGGA<br>CACACGAAATACGACCCTAAATTTCAAGTACGTGTCACGATG<br>ACTACCGACACTAGTACGAGCACTGTTTATATGGAATTGTCCT<br>CGTTACGCTCAGAGGATACGGCAGTCTATTATTGCAGCCGTTC<br>CGGAGGCTTACCCGACGTCTGGGGACAGGGAACTACTGTAAC<br>AGTCAGTAGT |
| 10026 | HC Variable | QVQLVQSGAEVKKPGASVKLSCKASGFDIQDTYMHWVRQAPG<br>QGLEWMGRIDPASGHTKYDPKFQVRVTMTTDTSTSTVYMELSS<br>LRSEDTAVYYCSRSGGLPDVWGQGTTVTVSS |
| 10027 | LC Variable | GAGATTGTGTTAACGCAATCACCGGGGACTTTATCGCTGTCG<br>CCGGGGGAGCGCGTTACAATGTCTTGTCGCGCTTCCTCTTCGG<br>TTTCATACATGTATTGGTATCAACAAAAACCGGGACAGGCTC<br>CACGCCCCTGGATTTACGCTACTAGCAATTTGGCCTCGGGCGT<br>TCCCGACCGCTTCAGCGGGTCAGGGAGCGGCACCGATTACAC<br>GTTGACCATCTCTCGTCTGGAACCTGAAGACTTCGCGGTCTAT<br>TACTGTCAACAATGGTCGGGAAATCCCCGTACATTTGGCGGA<br>GGGACGAAGTTGGAAATTAAA |
| 10028 | LC Variable | EIVLTQSPGTLSLSPGERVTMSCRASSSVSYMYWYQQKPGQAPR<br>PWIYATSNLASGVPDRFSGSGSGTDYTLTISRLEPEDFAVYYCQQ<br>WSGNPRTFGGGTKLEIK |
| 10029 | HCDR1 | GGGTTTGACATCCAGGACACCTACATGCAC |
| 10030 | HCDR2 | CGCATCGACCCCGCGAGCGGACACACGAAATACGACCCTAAA<br>TTTCAAGTA |
| 10031 | HCDR3 | TCCGGAGGCTTACCCGACGTC |
| 10032 | LCDR1 | CGCGCTTCCTCTTCGGTTTCATACATGTATTGGTAT |
| 10033 | LCDR2 | GCTACTAGCAATTTGGCCTCG |
| 10034 | LCDR3 | CAACAATGGTCGGGAAATCCCCGTACA |
| 10035 | LC Variable | CAAGTACAATTAGTCCAGTCGGGTGCCGAGGTAAAAAAACCT<br>GGAGCATCCGTAAAACTGTCTTGCAAAGCATCGGGGTTTGAC<br>ATCCAGGACACCTACATGCACTGGGTGCGTCAAGCTCCAGGA<br>CAGGGATTAGAGTGGATGGGTCGCATCGACCCCGCGAGCGGA<br>CACACGAAATACGACCCTAAATTTCAAGTACGTGTCACGATG<br>ACTCGTGACACTAGTACGAGCACTGTTTATATGGAATTGTCCT<br>CGTTACGCTCAGAGGATACGGCAGTCTATTATTGCAGCCGTTC<br>CGGAGGCTTACCCGACGTCTGGGGACAGGGAACTACTGTAAC<br>AGTCAGTAGT |
| 10036 | LC Variable | QVQLVQSGAEVKKPGASVKLSCKASGFDIQDTYMHWVRQAPG<br>QGLEWMGRIDPASGHTKYDPKFQVRVTMTRDTSTSTVYMELSS<br>LRSEDTAVYYCSRSGGLPDVWGQGTTVTVSS |
| 10037 | LC Variable | GAGATTGTGTTAACGCAATCACCGGGGACTTTATCGCTGTCG<br>CCGGGGAGCGCGCGACACTGTCTTGTCGCGCTTCCTCTTCGG<br>TTTCATACATGTATTGGTATCAACAAAAACCGGGACAGGCTC<br>CACGCCTGCTGATTTACGCTACTAGCAATTTGGCCTCGGGCAT<br>CCCCGACCGCTTCAGCGGGTCAGGGAGCGGCACCGATTTTAC<br>GTTGACCATCTCTCGTCTGGAACCTGAAGACTTCGCGGTCTAT<br>TACTGTCAACAATGGTCGGGAAATCCCCGTACATTTGGCGGA<br>GGGACGAAGTTGGAAATTAAA |
| 10038 | LC Variable | EIVLTQSPGTLSLSPGERATLSCRASSSVSYMYWYQQKPGQAPR<br>LLIYATSNLASGIPDRFSGSGSGTDFTLTISRLEPEDFAVYYCQQW<br>SGNPRTFGGGTKLEIK |
| 10039 | HC Variable | CAAGTACAATTAGTCCAGTCGGGTGCCGAGGTAAAAAAACCT<br>GGAGCATCCGTAAAAGTCTCTTGCAAAGCATCGGGGTTTGAC<br>ATCCAGGACACCTACATGCACTGGGTGCGTCAAGCTCCAGGA<br>CAGGGATTAGAGTGGATGGGTCGCATCGACCCCGCGAGCGGA<br>CACACGAAATACGACCCTAAATTTCAAGTACGTGTCACGATG<br>ACTCGTGACACTAGTACGAGCACTGTTTATATGGAATTGTCCT |

TABLE 2A-continued

Non-Limiting Examples of anti-TL1A and anti-DR3 Antibodies and Portions Thereof

| SEQ ID | Antibody Region | Sequence |
|---|---|---|
|  |  | CGTTACGCTCAGAGGATACGGCAGTCTATTATTGCGCACGTTC CGGAGGCTTACCCGACGTCTGGGGACAGGGAACTACTGTAAC AGTCAGTAGT |
| 10040 | HC Variable | QVQLVQSGAEVKKPGASVKVSCKASGFDIQDTYMHWVRQAPG QGLEWMGRIDPASGHTKYDPKFQVRVTMTRDTSTSTVYMELSS LRSEDTAVYYCARSGGLPDVWGQGTTVTVSS |
| 10041 | HC Variable | GAGATTGTGTTAACGCAATCACCGGGGACTTTATCGCTGTCG CCGGGGGAGCGCGCGACACTGTCTTGTCGCGCTTCCTCTTCGG TTTCATACATGTATTGGTATCAACAAAAACCGGGACAGGCTC CACGCCTGCTGATTTACGCTACTAGCAATTTGGCCTCGGGCGT TCCCGACCGCTTCAGCGGGTCAGGGAGCGGCACCGATTACAC GTTGACCATCTCTCGTCTGGAACCTGAAGACTTCGCGGTCTAT TACTGTCAACAATGTCGGGAAATCCCCGTACATTTGGCGGA GGGACGAAGTTGGAAATTAAA |
| 10042 | HC Variable | EIVLTQSPGTLSLSPGERATLSCRASSSVSYMYWYQQKPGQAPR LLIYATSNLASGVPDRFSGSGSGTDYTLTISRLEPEDFAVYYCQQ WSGNPRTFGGGTKLEIK |
| 10043 | HC Variable | QVQLVQSGAEVKKPGASVKVSCKASGFDIQDTYMHWVRQAPG QGLEWMGRIDPASGHTKYDPKFQVRVTMTRDTSTSTVYMELSS LRSEDTAVYYCARSGGLPDKWGQGTTVTVSS |
| 10044 | HC Variable | QVQLVQSGAEVKKPGASVKVSCKASGFDIQDTYMHWVRQAPG QGLEWMGRIDPASGHTKYDPKFQVRVTMTRDTSTSTVYMELSS LRSEDTAVYYCARSGGLPDMWGQGTTVTVSS |
| 10045 | HC Variable | QVQLVQSGAEVKKPGASVKVSCKASGFDIQDTYMHWVRQAPG QGLEWMGRIDPASGHTKYDPKFQVRVTMTRDTSTSTVYMELSS LRSEDTAVYYCARSGGLPDQWGQGTTVTVSS |
| 10046 | HC Variable | QVQLVQSGAEVKKPGASVKVSCKASGFDIQDTYMHWVRQAPG QGLEWMGRIDPASGHTKYDPKFQVRVTMTRDTSTSTVYMELSS LRSEDTAVYYCARSGGLPDWWGQGTTVTVSS |
| 10047 | LC Variable | EIVLTQSPGTLSLSPGERATLSCRASSSVSYMYWYQQKPGQAPR LLIYATSNLASGIPDRFSGSGSGTDFTLTISRLEPEDFAVYYCQQW DGNPRTFGGGTKLEIK |
| 10048 | LC Variable | EIVLTQSPGTLSLSPGERATLSCRASSSVSYMYWYQQKPGQAPR LLIYATSNLASGIPDRFSGSGSGTDFTLTISRLEPEDFAVYYCQQW EGNPRTFGGGTKLEIK |
| 10049 | LC Variable | EIVLTQSPGTLSLSPGERATLSCRASSSVSYMYWYQQKPGQAPR LLIYATSNLASGIPDRFSGSGSGTDFTLTISRLEPEDFAVYYCQQW HGNPRTFGGGTKLEIK |
| 10050 | LC Variable | EIVLTQSPGTLSLSPGERATLSCRASSSVSYMYWYQQKPGQAPR LLIYATSNLASGIPDRFSGSGSGTDFTLTISRLEPEDFAVYYCQQW NGNPRTFGGGTKLEIK |
| 10051 | LC Variable | EIVLTQSPGTLSLSPGERATLSCRASSSVSYMYWYQQKPGQAPR LLIYATSNLASGIPDRFSGSGSGTDFTLTISRLEPEDFAVYYCQQW QGNPRTFGGGTKLEIK |
| 10052 | HC Variable | QVQLVQSGAEVKKPGASVKVSCKASGFX$_1$X2X$_3$DTX$_4$X$_5$HWVRQ APGQGLEWMGRIDPASGHTKYDPKFQVRVTMTRDTSTSTVYME LSSLRSEDTAVYYCARSGGX$_6$PDX$_7$WGQGTTVTVSS<br>X$_1$ = D, OR E<br>X$_2$ = I, P, OR V<br>X$_3$ = G, Q, S, OR V<br>X$_4$ = F, OR Y<br>X$_5$ = I, OR M<br>X$_6$ = L, OR M<br>X$_7$ = E, I, K, L, M, Q, T, V, W, OR Y |
| 10053 | LC Variable | EIVLTQSPGTLSLSPGERATLSCRASSSVSYMYWYQQKPGQAPR LLIYATSNLASGIPDRFSGSGSGTDFTLTISRLEPEDFAVYYCX$_1$Q WX$_2$X$_3$X$_4$PRTFGGGTKLEIK |

TABLE 2A-continued

Non-Limiting Examples of anti-TL1A and anti-DR3 Antibodies and Portions Thereof

| SEQ ID | Antibody Region | Sequence |
|---|---|---|
| | | $X_1$ = Q, OR N<br>$X_2$ = D, E, H, N, Q, OR S<br>$X_3$ = A, OR G<br>$X_4$ = D, F, K, N, R, S, OR T |
| 10054 | HC Variable | QVQLVQSGAEVKKPGASVKVSCKASGFX$_1$X$_2$X$_3$DTX$_4$X$_5$HWVRQ APGQGLEWMGRIDPASGHTKYDPKFQVRVTMTRDTSTSTVYME LSSLRSEDTAVYYCSRSGGX$_6$PDX$_7$WGQGTTVTVSS<br>$X_1$ = D, OR E<br>$X_2$ = I, P, OR V<br>$X_3$ = G, Q, S, OR V<br>$X_4$ = F, OR Y<br>$X_5$ = I, OR M<br>$X_6$ = L, OR M<br>$X_7$ = E, I, K, L, M, Q, T, V, W, OR Y |
| 100100 | HCFR1a | QVQLVQSGAEVKKPGASVKLSCKAS |
| 100101 | HCFR2a | WVRQAPGQGLEWMG |
| 100102 | HCFR3a | RVTMTRDTSTSTVYMELSSLRSEDTAVYYCSR |
| 100103 | HCFR4a | WGQGTTVTVSS |
| 100104 | LCFR1a | EIVLTQSPGTLSLSPGERATLSC |
| 100105 | LCFR2a | WYQQKPGQAPRLLIY |
| 100106 | LCFR3a | GIPDRFSGSGSGTDFTLTISRLEPEDFAVYYC |
| 100107 | LCFR4a | FGGGTKLEIK |
| 100108 | HCFR1b | QVQLVQSGAEVKKPGASVKVSCKAS |
| 100109 | HCFR3b | RVTMTRDTSTSTVYMELSSLRSEDTAVYYCAR |
| 100110 | LCFR3b | GVPDRFSGSGSGTDYTLTISRLEPEDFAVYYC |
| 100150 | HCDR1 A | GFX$_1$X2X$_3$DTX$_4$X$_5$H<br>$X_1$ = D, OR E<br>$X_2$ = I, P, OR V<br>$X_3$ = G, Q, S, OR V<br>$X_4$ = F, OR Y<br>$X_5$ = I, OR M |
| 100152 | HCDR3 A | SGGX$_1$PDX$_2$<br>$X_1$ = L, OR M<br>$X_2$ = E, I, K, L, M, Q, T, V, W, OR Y |
| 100155 | LCDR3 A | X$_1$QWX$_2$X$_3$X$_4$PRT<br>$X_1$ = Q, OR N<br>$X_2$ = D, E, H, N, Q, OR S<br>$X_3$ = A, OR G<br>$X_4$ = D, F, K, N, R, S, OR T |
| 100200 | HCDR1 A1 | GFDIGDTFIH |
| 100201 | HCDR1 B1 | GFDIGDTFMH |
| 100202 | HCDR1 C1 | GFDIGDTYIH |
| 100203 | HCDR1 D1 | GFDIGDTYMH |
| 100204 | HCDR1 E1 | GFDIQDTFIH |
| 100205 | HCDR1 F1 | GFDIQDTFMH |
| 100206 | HCDR1 G1 | GFDIQDTYIH |
| 100207 | HCDR1 H1 | GFDIQDTYMH |
| 100208 | HCDR1 I1 | GFDISDTFIH |
| 100209 | HCDR1 J1 | GFDISDTFMH |

TABLE 2A-continued

Non-Limiting Examples of anti-TL1A and anti-DR3 Antibodies and Portions Thereof

| SEQ ID | Antibody Region | Sequence |
|---|---|---|
| 100210 | HCDR1 K1 | GFDISDTYIH |
| 100211 | HCDR1 L1 | GFDISDTYMH |
| 100212 | HCDR1 M1 | GFDIVDTFIH |
| 100213 | HCDR1 N1 | GFDIVDTFMH |
| 100214 | HCDR1 O1 | GFDIVDTYIH |
| 100215 | HCDR1 P1 | GFDIVDTYMH |
| 100216 | HCDR1 Q1 | GFDPGDTFIH |
| 100217 | HCDR1 R1 | GFDPGDTFMH |
| 100218 | HCDR1 S1 | GFDPGDTYIH |
| 100219 | HCDR1 T1 | GFDPGDTYMH |
| 100220 | HCDR1 U1 | GFDPQDTFIH |
| 100221 | HCDR1 V1 | GFDPQDTFMH |
| 100222 | HCDR1 W1 | GFDPQDTYIH |
| 100223 | HCDR1 X1 | GFDPQDTYMH |
| 100224 | HCDR1 Y1 | GFDPSDTFIH |
| 100225 | HCDR1 Z1 | GFDPSDTFMH |
| 100226 | HCDR1 A2 | GFDPSDTYIH |
| 100227 | HCDR1 B2 | GFDPSDTYMH |
| 100228 | HCDR1 C2 | GFDPVDTFIH |
| 100229 | HCDR1 D2 | GFDPVDTFMH |
| 100230 | HCDR1 E2 | GFDPVDTYIH |
| 100231 | HCDR1 F2 | GFDPVDTYMH |
| 100232 | HCDR1 G2 | GFDVGDTFIH |
| 100233 | HCDR1 H2 | GFDVGDTFMH |
| 100234 | HCDR1 I2 | GFDVGDTYIH |
| 100235 | HCDR1 J2 | GFDVGDTYMH |
| 100236 | HCDR1 K2 | GFDVQDTFIH |
| 100237 | HCDR1 L2 | GFDVQDTFMH |
| 100238 | HCDR1 M2 | GFDVQDTYIH |
| 100239 | HCDR1 N2 | GFDVQDTYMH |
| 100240 | HCDR1 O2 | GFDVSDTFIH |
| 100241 | HCDR1 P2 | GFDVSDTFMH |
| 100242 | HCDR1 Q2 | GFDVSDTYIH |
| 100243 | HCDR1 R2 | GFDVSDTYMH |
| 100244 | HCDR1 S2 | GFDVVDTFIH |
| 100245 | HCDR1 T2 | GFDVVDTFMH |
| 100246 | HCDR1 U2 | GFDVVDTYIH |

TABLE 2A-continued

Non-Limiting Examples of anti-TL1A and anti-DR3 Antibodies and Portions Thereof

| SEQ ID | Antibody Region | Sequence |
|---|---|---|
| 100247 | HCDR1 V2 | GFDVVDTYMH |
| 100248 | HCDR1 W2 | GFEIGDTFIH |
| 100249 | HCDR1 X2 | GFEIGDTFMH |
| 100250 | HCDR1 Y2 | GFEIGDTYIH |
| 100251 | HCDR1 Z2 | GFEIGDTYMH |
| 100252 | HCDR1 A3 | GFEIQDTFIH |
| 100253 | HCDR1 B3 | GFEIQDTFMH |
| 100254 | HCDR1 C3 | GFEIQDTYIH |
| 100255 | HCDR1 D3 | GFEIQDTYMH |
| 100256 | HCDR1 E3 | GFEISDTFIH |
| 100257 | HCDR1 F3 | GFEISDTFMH |
| 100258 | HCDR1 G3 | GFEISDTYIH |
| 100259 | HCDR1 H3 | GFEISDTYMH |
| 100260 | HCDR1 I3 | GFEIVDTFIH |
| 100261 | HCDR1 J3 | GFEIVDTFMH |
| 100262 | HCDR1 K3 | GFEIVDTYIH |
| 100263 | HCDR1 L3 | GFEIVDTYMH |
| 100264 | HCDR1 M3 | GFEPGDTFIH |
| 100265 | HCDR1 N3 | GFEPGDTFMH |
| 100266 | HCDR1 O3 | GFEPGDTYIH |
| 100267 | HCDR1 P3 | GFEPGDTYMH |
| 100268 | HCDR1 Q3 | GFEPQDTFIH |
| 100269 | HCDR1 R3 | GFEPQDTFMH |
| 100270 | HCDR1 S3 | GFEPQDTYIH |
| 100271 | HCDR1 T3 | GFEPQDTYMH |
| 100272 | HCDR1 U3 | GFEPSDTFIH |
| 100273 | HCDR1 V3 | GFEPSDTFMH |
| 100274 | HCDR1 W3 | GFEPSDTYIH |
| 100275 | HCDR1 X3 | GFEPSDTYMH |
| 100276 | HCDR1 Y3 | GFEPVDTFIH |
| 100277 | HCDR1 Z3 | GFEPVDTFMH |
| 100278 | HCDR1 A4 | GFEPVDTYIH |
| 100279 | HCDR1 B4 | GFEPVDTYMH |
| 100280 | HCDR1 C4 | GFEVGDTFIH |
| 100281 | HCDR1 D4 | GFEVGDTFMH |
| 100282 | HCDR1 E4 | GFEVGDTYIH |
| 100283 | HCDR1 F4 | GFEVGDTYMH |

TABLE 2A-continued

Non-Limiting Examples of anti-TL1A and anti-DR3 Antibodies and Portions Thereof

| SEQ ID | Antibody Region | Sequence |
|---|---|---|
| 100284 | HCDR1 G4 | GFEVQDTFIH |
| 100285 | HCDR1 H4 | GFEVQDTFMH |
| 100286 | HCDR1 I4 | GFEVQDTYIH |
| 100287 | HCDR1 J4 | GFEVQDTYMH |
| 100288 | HCDR1 K4 | GFEVSDTFIH |
| 100289 | HCDR1 L4 | GFEVSDTFMH |
| 100290 | HCDR1 M4 | GFEVSDTYIH |
| 100291 | HCDR1 N4 | GFEVSDTYMH |
| 100292 | HCDR1 O4 | GFEVVDTFIH |
| 100293 | HCDR1 P4 | GFEVVDTFMH |
| 100294 | HCDR1 Q4 | GFEVVDTYIH |
| 100295 | HCDR1 R4 | GFEVVDTYMH |
| 100296 | HCDR3 A1 | SGGLPDE |
| 100297 | HCDR3 B1 | SGGLPDI |
| 100298 | HCDR3 C1 | SGGLPDK |
| 100299 | HCDR3 D1 | SGGLPDL |
| 100300 | HCDR3 E1 | SGGLPDM |
| 100301 | HCDR3 F1 | SGGLPDQ |
| 100302 | HCDR3 G1 | SGGLPDT |
| 100303 | HCDR3 H1 | SGGLPDW |
| 100304 | HCDR3 I1 | SGGLPDY |
| 100305 | HCDR3 J1 | SGGMPDE |
| 100306 | HCDR3 K1 | SGGMPDI |
| 100307 | HCDR3 L1 | SGGMPDK |
| 100308 | HCDR3 M1 | SGGMPDL |
| 100309 | HCDR3 N1 | SGGMPDM |
| 100310 | HCDR3 O1 | SGGMPDQ |
| 100311 | HCDR3 P1 | SGGMPDT |
| 100312 | HCDR3 Q1 | SGGMPDV |
| 100313 | HCDR3 R1 | SGGMPDW |
| 100314 | HCDR3 S1 | SGGMPDY |
| 100315 | LCDR3 A1 | QQWDADPRT |
| 100316 | LCDR3 B1 | QQWDAFPRT |
| 100317 | LCDR3 C1 | QQWDAKPRT |
| 100318 | LCDR3 D1 | QQWDANPRT |
| 100319 | LCDR3 E1 | QQWDARPRT |
| 100320 | LCDR3 F1 | QQWDASPRT |

TABLE 2A-continued

Non-Limiting Examples of anti-TL1A and anti-DR3 Antibodies and Portions Thereof

| SEQ ID | Antibody Region | Sequence |
|---|---|---|
| 100321 | LCDR3 G1 | QQWDATPRT |
| 100322 | LCDR3 H1 | QQWDGDPRT |
| 100323 | LCDR3 I1 | QQWDGFPRT |
| 100324 | LCDR3 J1 | QQWDGKPRT |
| 100325 | LCDR3 K1 | QQWDGNPRT |
| 100326 | LCDR3 L1 | QQWDGRPRT |
| 100327 | LCDR3 M1 | QQWDGSPRT |
| 100328 | LCDR3 N1 | QQWDGTPRT |
| 100329 | LCDR3 O1 | QQWEADPRT |
| 100330 | LCDR3 P1 | QQWEAFPRT |
| 100331 | LCDR3 Q1 | QQWEAKPRT |
| 100332 | LCDR3 R1 | QQWEANPRT |
| 100333 | LCDR3 S1 | QQWEARPRT |
| 100334 | LCDR3 T1 | QQWEASPRT |
| 100335 | LCDR3 U1 | QQWEATPRT |
| 100336 | LCDR3 V1 | QQWEGDPRT |
| 100337 | LCDR3 W1 | QQWEGFPRT |
| 100338 | LCDR3 X1 | QQWEGKPRT |
| 100339 | LCDR3 Y1 | QQWEGNPRT |
| 100340 | LCDR3 Z1 | QQWEGRPRT |
| 100341 | LCDR3 A2 | QQWEGSPRT |
| 100342 | LCDR3 B2 | QQWEGTPRT |
| 100343 | LCDR3 C2 | QQWHADPRT |
| 100344 | LCDR3 D2 | QQWHAFPRT |
| 100345 | LCDR3 E2 | QQWHAKPRT |
| 100346 | LCDR3 F2 | QQWHANPRT |
| 100347 | LCDR3 G2 | QQWHARPRT |
| 100348 | LCDR3 H2 | QQWHASPRT |
| 100349 | LCDR3 I2 | QQWHATPRT |
| 100350 | LCDR3 J2 | QQWHGDPRT |
| 100351 | LCDR3 K2 | QQWHGFPRT |
| 100352 | LCDR3 L2 | QQWHGKPRT |
| 100353 | LCDR3 M2 | QQWHGNPRT |
| 100354 | LCDR3 N2 | QQWHGRPRT |
| 100355 | LCDR3 O2 | QQWHGSPRT |
| 100356 | LCDR3 P2 | QQWHGTPRT |
| 100357 | LCDR3 Q2 | QQWNADPRT |

TABLE 2A-continued

Non-Limiting Examples of anti-TL1A and anti-DR3 Antibodies and Portions Thereof

| SEQ ID | Antibody Region | Sequence |
|---|---|---|
| 100358 | LCDR3 R2 | QQWNAFPRT |
| 100359 | LCDR3 S2 | QQWNAKPRT |
| 100360 | LCDR3 T2 | QQWNANPRT |
| 100361 | LCDR3 U2 | QQWNARPRT |
| 100362 | LCDR3 V2 | QQWNASPRT |
| 100363 | LCDR3 W2 | QQWNATPRT |
| 364100 | LCDR3 X2 | QQWNGDPRT |
| 100365 | LCDR3 Y2 | QQWNGFPRT |
| 100366 | LCDR3 Z2 | QQWNGKPRT |
| 100367 | LCDR3 A3 | QQWNGNPRT |
| 100368 | LCDR3 B3 | QQWNGRPRT |
| 100369 | LCDR3 C3 | QQWNGSPRT |
| 100370 | LCDR3 D3 | QQWNGTPRT |
| 100371 | LCDR3 E3 | QQWQADPRT |
| 100372 | LCDR3 F3 | QQWQAFPRT |
| 100373 | LCDR3 G3 | QQWQAKPRT |
| 100374 | LCDR3 H3 | QQWQANPRT |
| 100375 | LCDR3 I3 | QQWQARPRT |
| 100376 | LCDR3 J3 | QQWQASPRT |
| 100377 | LCDR3 K3 | QQWQATPRT |
| 100378 | LCDR3 L3 | QQWQGDPRT |
| 100379 | LCDR3 M3 | QQWQGFPRT |
| 100380 | LCDR3 N3 | QQWQGKPRT |
| 100381 | LCDR3 O3 | QQWQGNPRT |
| 100382 | LCDR3 P3 | QQWQGRPRT |
| 100383 | LCDR3 Q3 | QQWQGSPRT |
| 100384 | LCDR3 R3 | QQWQGTPRT |
| 100385 | LCDR3 S3 | QQWSADPRT |
| 100386 | LCDR3 T3 | QQWSAFPRT |
| 100387 | LCDR3 U3 | QQWSAKPRT |
| 100388 | LCDR3 V3 | QQWSANPRT |
| 100389 | LCDR3 W3 | QQWSARPRT |
| 100390 | LCDR3 X3 | QQWSASPRT |
| 100391 | LCDR3 Y3 | QQWSATPRT |
| 100392 | LCDR3 Z3 | QQWSGDPRT |
| 100393 | LCDR3 A4 | QQWSGFPRT |
| 100394 | LCDR3 B4 | QQWSGKPRT |

TABLE 2A-continued

Non-Limiting Examples of anti-TL1A and anti-DR3 Antibodies and Portions Thereof

| SEQ ID | Antibody Region | Sequence |
|---|---|---|
| 100395 | LCDR3 C4 | QQWSGNPRT |
| 100396 | LCDR3 D4 | QQWSGRPRT |
| 100397 | LCDR3 E4 | QQWSGSPRT |
| 100398 | LCDR3 F4 | QQWSGTPRT |
| 100399 | LCDR3 G4 | QQWDADPRT |
| 100400 | LCDR3 H4 | NQWDAFPRT |
| 100401 | LCDR3 I4 | NQWDAKPRT |
| 100402 | LCDR3 J4 | NQWDANPRT |
| 100403 | LCDR3 K4 | NQWDARPRT |
| 100404 | LCDR3 L4 | NQWDASPRT |
| 100405 | LCDR3 M4 | NQWDATPRT |
| 100406 | LCDR3 N4 | NQWDGDPRT |
| 100407 | LCDR3 O4 | NQWDGFPRT |
| 100408 | LCDR3 P4 | NQWDGKPRT |
| 100409 | LCDR3 Q4 | NQWDGNPRT |
| 100410 | LCDR3 R4 | NQWDGRPRT |
| 100411 | LCDR3 S4 | NQWDGSPRT |
| 100412 | LCDR3 T4 | NQWDGTPRT |
| 100413 | LCDR3 U4 | NQWEADPRT |
| 100414 | LCDR3 V4 | NQWEAFPRT |
| 100415 | LCDR3 W4 | NQWEAKPRT |
| 100416 | LCDR3 X4 | NQWEANPRT |
| 100417 | LCDR3 Y4 | NQWEARPRT |
| 100418 | LCDR3 Z4 | NQWEASPRT |
| 100419 | LCDR3 A5 | NQWEATPRT |
| 100420 | LCDR3 B5 | NQWEGDPRT |
| 100421 | LCDR3 C5 | NQWEGFPRT |
| 100422 | LCDR3 D5 | NQWEGKPRT |
| 100423 | LCDR3 E5 | NQWEGNPRT |
| 100424 | LCDR3 F5 | NQWEGRPRT |
| 100425 | LCDR3 G5 | NQWEGSPRT |
| 100426 | LCDR3 H5 | NQWEGTPRT |
| 100427 | LCDR3 I5 | NQWHADPRT |
| 100428 | LCDR3 J5 | NQWHAFPRT |
| 100429 | LCDR3 K5 | NQWHAKPRT |
| 100430 | LCDR3 L5 | NQWHANPRT |
| 100431 | LCDR3 M5 | NQWHARPRT |

TABLE 2A-continued

Non-Limiting Examples of anti-TL1A and anti-DR3 Antibodies and Portions Thereof

| SEQ ID | Antibody Region | Sequence |
| --- | --- | --- |
| 100432 | LCDR3 N5 | NQWHASPRT |
| 100433 | LCDR3 O5 | NQWHATPRT |
| 100434 | LCDR3 P5 | NQWHGDPRT |
| 100435 | LCDR3 Q5 | NQWHGFPRT |
| 100436 | LCDR3 R5 | NQWHGKPRT |
| 100437 | LCDR3 S5 | NQWHGNPRT |
| 100438 | LCDR3 T5 | NQWHGRPRT |
| 100439 | LCDR3 U5 | NQWHGSPRT |
| 100440 | LCDR3 V5 | NQWHGTPRT |
| 100441 | LCDR3 W5 | NQWNADPRT |
| 100442 | LCDR3 X5 | NQWNAFPRT |
| 100443 | LCDR3 Y5 | NQWNAKPRT |
| 100444 | LCDR3 Z5 | NQWNANPRT |
| 100445 | LCDR3 A6 | NQWNARPRT |
| 100446 | LCDR3 B6 | NQWNASPRT |
| 100447 | LCDR3 C6 | NQWNATPRT |
| 100448 | LCDR3 D6 | NQWNGDPRT |
| 100449 | LCDR3 E6 | NQWNGFPRT |
| 100450 | LCDR3 F6 | NQWNGKPRT |
| 100451 | LCDR3 G6 | NQWNGNPRT |
| 100452 | LCDR3 H6 | NQWNGRPRT |
| 100453 | LCDR3 I6 | NQWNGSPRT |
| 100454 | LCDR3 J6 | NQWNGTPRT |
| 100455 | LCDR3 K6 | NQWQADPRT |
| 100456 | LCDR3 L6 | NQWQAFPRT |
| 100457 | LCDR3 M6 | NQWQAKPRT |
| 100458 | LCDR3 N6 | NQWQANPRT |
| 100459 | LCDR3 O6 | NQWQARPRT |
| 100460 | LCDR3 P6 | NQWQASPRT |
| 100461 | LCDR3 Q6 | NQWQATPRT |
| 100462 | LCDR3 R6 | NQWQGDPRT |
| 100463 | LCDR3 S6 | NQWQGFPRT |
| 100464 | LCDR3 T6 | NQWQGKPRT |
| 100465 | LCDR3 U6 | NQWQGNPRT |
| 100466 | LCDR3 V6 | NQWQGRPRT |
| 100467 | LCDR3 W6 | NQWQGSPRT |
| 100468 | LCDR3 X6 | NQWQGTPRT |

TABLE 2A-continued

Non-Limiting Examples of anti-TL1A and anti-DR3 Antibodies and Portions Thereof

| SEQ ID | Antibody Region | Sequence |
|---|---|---|
| 100469 | LCDR3 Y6 | NQWSADPRT |
| 100470 | LCDR3 Z6 | NQWSAFPRT |
| 100471 | LCDR3 A7 | NQWSAKPRT |
| 100472 | LCDR3 B7 | NQWSANPRT |
| 100473 | LCDR3 C7 | NQWSARPRT |
| 100474 | LCDR3 D7 | NQWSASPRT |
| 100475 | LCDR3 E7 | NQWSATPRT |
| 100476 | LCDR3 F7 | NQWSGDPRT |
| 100477 | LCDR3 G7 | NQWSGFPRT |
| 100478 | LCDR3 H7 | NQWSGKPRT |
| 100479 | LCDR3 I7 | NQWSGNPRT |
| 100480 | LCDR3 J7 | NQWSGRPRT |
| 100481 | LCDR3 K7 | NQWSGSPRT |
| 100482 | LCDR3 L7 | NQWSGTPRT |

TABLE 2B

Non-Limiting Examples of anti-TL1A and anti-DR3 Antibodies

| Antibody Name | HC Variable Domain (SEQ ID NO) | LC Variable Domain (SEQ ID NO) |
|---|---|---|
| A100 | 115 | 116 |
| A101 | 123 | 124 |
| A102 | 131 | 132 |
| A103 | 142 | 143 |
| A104 | 152 | 153 |
| A105 | 160 | 161 |
| A106 | 171 | 175 |
| A107 | 171 | 176 |
| A108 | 171 | 177 |
| A109 | 171 | 178 |
| A110 | 171 | 179 |
| A111 | 171 | 180 |
| A112 | 171 | 181 |
| A113 | 171 | 182 |
| A114 | 172 | 175 |
| A115 | 172 | 176 |
| A116 | 172 | 177 |
| A117 | 172 | 178 |
| A118 | 172 | 179 |
| A119 | 172 | 180 |
| A120 | 172 | 181 |
| A121 | 172 | 182 |
| A122 | 173 | 175 |
| A123 | 173 | 176 |
| A124 | 173 | 177 |
| A125 | 173 | 178 |
| A126 | 173 | 179 |
| A127 | 173 | 180 |
| A128 | 173 | 181 |
| A129 | 173 | 182 |
| A130 | 174 | 175 |
| A131 | 174 | 176 |
| A132 | 174 | 177 |
| A133 | 174 | 178 |
| A134 | 174 | 179 |
| A135 | 174 | 180 |
| A136 | 174 | 181 |
| A137 | 174 | 182 |
| A138 | 189 | 194 |
| A139 | 189 | 195 |
| A140 | 189 | 196 |
| A141 | 189 | 197 |
| A142 | 190 | 194 |
| A143 | 190 | 195 |
| A144 | 190 | 196 |
| A145 | 190 | 197 |
| A146 | 191 | 194 |
| A147 | 191 | 195 |
| A148 | 191 | 196 |
| A149 | 191 | 197 |
| A150 | 192 | 194 |
| A151 | 192 | 195 |
| A152 | 192 | 196 |
| A153 | 192 | 197 |
| A154 | 193 | 194 |
| A155 | 193 | 195 |
| A156 | 193 | 196 |
| A157 | 193 | 197 |
| A158 | 204 | 205 |
| A159 | 206 | 207 |
| A160 | 208 | 209 |
| A161 | 210 | 211 |
| A162 | 212 | 213 |
| A163 | 214 | 215 |
| A164 | 216 | 217 |
| A165 | 218 | 219 |
| A166 | 220 | 221 |
| A167 | 222 | 223 |

TABLE 2B-continued

Non-Limiting Examples of anti-TL1A and anti-DR3 Antibodies

| Antibody Name | HC Variable Domain (SEQ ID NO) | LC Variable Domain (SEQ ID NO) |
|---|---|---|
| A168 | 224 | 225 |
| A169 | 226 | 227 |
| A170 | 234 | 235 |
| A171 | 242 | 243 |
| A172 | 244 | 245 |
| A173 | 252 | 253 |
| A174 | 254 | 255 |
| A175 | 256 | 257 |
| A176 | 282 | 283 |
| A177 | 290 | 291 |
| A178 | 258 | 271 |
| A179 | 258 | 272 |
| A180 | 258 | 273 |
| A181 | 258 | 274 |
| A182 | 258 | 275 |
| A183 | 259 | 271 |
| A184 | 259 | 272 |
| A185 | 259 | 273 |
| A186 | 259 | 274 |
| A187 | 259 | 275 |
| A188 | 260 | 271 |
| A189 | 260 | 272 |
| A190 | 260 | 273 |
| A191 | 260 | 274 |
| A192 | 260 | 275 |
| A193 | 261 | 271 |
| A194 | 261 | 272 |
| A195 | 261 | 273 |
| A196 | 261 | 274 |
| A197 | 261 | 275 |
| A198 | 262 | 271 |
| A199 | 262 | 272 |
| A200 | 262 | 273 |
| A201 | 262 | 274 |
| A202 | 262 | 275 |
| A203 | 263 | 271 |
| A204 | 263 | 272 |
| A205 | 263 | 273 |
| A206 | 263 | 274 |
| A207 | 263 | 275 |
| A208 | 264 | 271 |
| A209 | 264 | 272 |
| A210 | 264 | 273 |
| A211 | 264 | 274 |
| A212 | 264 | 275 |
| A213 | 265 | 271 |
| A214 | 265 | 272 |
| A215 | 265 | 273 |
| A216 | 265 | 274 |
| A217 | 265 | 275 |
| A218 | 266 | 271 |
| A219 | 266 | 272 |
| A220 | 266 | 273 |
| A221 | 266 | 274 |
| A222 | 266 | 275 |
| A223 | 267 | 271 |
| A224 | 267 | 272 |
| A225 | 267 | 273 |
| A226 | 267 | 274 |
| A227 | 267 | 275 |
| A228 | 268 | 271 |
| A229 | 268 | 272 |
| A230 | 268 | 273 |
| A231 | 268 | 274 |
| A232 | 268 | 275 |
| A233 | 269 | 271 |
| A234 | 269 | 272 |
| A235 | 269 | 273 |
| A236 | 269 | 274 |
| A237 | 269 | 275 |
| A238 | 270 | 271 |
| A239 | 270 | 272 |
| A240 | 270 | 273 |
| A241 | 270 | 274 |
| A242 | 270 | 275 |

Dosages and Routes of Administration

In general, methods disclosed herein comprise administering a therapeutic agent by oral administration. However, in some instances, methods comprise administering a therapeutic agent by intraperitoneal injection. In some instances, methods comprise administering a therapeutic agent in the form of an anal suppository. In some instances, methods comprise administering a therapeutic agent by intravenous ("i.v.") administration. It is conceivable that one may also administer therapeutic agents disclosed herein by other routes, such as subcutaneous injection, intramuscular injection, intradermal injection, transdermal injection percutaneous administration, intranasal administration, intralymphatic injection, rectal administration intragastric administration, or any other suitable parenteral administration. In some embodiments, routes for local delivery closer to site of injury or inflammation are preferred over systemic routes. Routes, dosage, time points, and duration of administrating therapeutics may be adjusted. In some embodiments, administration of therapeutics is prior to, or after, onset of either, or both, acute and chronic symptoms of the disease or condition.

An effective dose and dosage of therapeutics to prevent or treat the disease or condition disclosed herein is defined by an observed beneficial response related to the disease or condition, or symptom of the disease or condition. Beneficial response comprises preventing, alleviating, arresting, or curing the disease or condition, or symptom of the disease or condition (e.g., reduced instances of diarrhea, rectal bleeding, weight loss, and size or number of intestinal lesions or strictures, reduced fibrosis or fibrogenesis, reduced fibrostenosis, reduced inflammation). In some embodiments, the beneficial response may be measured by detecting a measurable improvement in the presence, level, or activity, of biomarkers, transcriptomic risk profile, or intestinal microbiome in the subject. An "improvement," as used herein refers to shift in the presence, level, or activity towards a presence, level, or activity, observed in normal individuals (e.g. individuals who do not suffer from the disease or condition). In instances wherein the therapeutic agent is not therapeutically effective or is not providing a sufficient alleviation of the disease or condition, or symptom of the disease or condition, then the dosage amount and/or route of administration may be changed, or an additional agent may be administered to the subject, along with the therapeutic agent. In some embodiments, as a patient is started on a regimen of a therapeutic agent, the patient is also weaned off (e.g., step-wise decrease in dose) a second treatment regimen.

Suitable dose and dosage administered to a subject is determined by factors including, but no limited to, the particular therapeutic agent, disease condition and its severity, the identity (e.g., weight, sex, age) of the subject in need of treatment, and can be determined according to the particular circumstances surrounding the case, including, e.g., the specific agent being administered, the route of administration, the condition being treated, and the subject or host being treated. In general, however, doses employed for adult human treatment are typically in the range of 0.01 mg-5000 mg per day. In one aspect, doses employed for adult human treatment are from about 1 mg to about 1000 mg per day. In one embodiment, the desired dose is conveniently presented in a single dose or in divided doses administered simultaneously (or over a short period of time) or at appropriate intervals, for example as two, three, four or more sub-doses per day. Non-limiting examples of effective dosages of for oral delivery of a therapeutic agent include between about 0.1 mg/kg and about 100 mg/kg of body weight per day, and preferably between about 0.5 mg/kg and about 50 mg/kg of body weight per day. In other instances, the oral delivery dosage of effective amount is about 1 mg/kg and about 10 mg/kg of body weight per day of active material. Non-limiting examples of effective dosages for intravenous administration of the therapeutic agent include at a rate between about 0.01 to 100 pmol/kg body weight/min. In some embodiments, the daily dosage or the amount of active in the dosage form are lower or higher than the ranges indicated herein, based on a number of variables in regard to an individual treatment regime. In various embodiments, the daily and unit dosages are altered depending on a number of variables including, but not limited to, the activity of the therapeutic agent used, the disease or condition to be treated, the mode of administration, the requirements of the individual subject, the severity of the disease or condition being treated, and the judgment of the practitioner.

In some embodiments, the administration of the therapeutic agent is hourly, once every 2 hours, 3 hours, 4 hours, 5 hours, 6 hours, 7 hours, 8 hours, 9 hours, 10 hours, 11 hours, 12 hours, 13 hours, 14 hours, 15 hours, 16 hours, 17 hours, 18 hours, 19 hours, 20 hours, 21 hours 22 hours, 23 hours, 1 day, 2 days, 3 days, 4 days, 5 days, 6 days, 7 days, 8 days, 9 days, 10 days, 11 days, 12 days, 13 days, 14 days, 15 days, 1 month, 2 months, 3 months, 4 months, 5 months, 6 months, 7 months, 8 months, 9 months, 10 months, 11 months, 1 year, 2 years, 3 years, 4 years, or 5 years, or 10 years. The effective dosage ranges may be adjusted based on subject's response to the treatment. Some routes of administration will require higher concentrations of effective amount of therapeutics than other routes.

In certain embodiments wherein the patient's condition does not improve, upon the doctor's discretion the administration of therapeutic agent is administered chronically, that is, for an extended period of time, including throughout the duration of the patient's life in order to ameliorate or otherwise control or limit the symptoms of the patient's disease or condition. In certain embodiments wherein a patient's status does improve, the dose of therapeutic agent being administered may be temporarily reduced or temporarily suspended for a certain length of time (i.e., a "drug holiday"). In specific embodiments, the length of the drug holiday is between 2 days and 1 year, including by way of example only, 2 days, 3 days, 4 days, 5 days, 6 days, 7 days, 10 days, 12 days, 15 days, 20 days, 28 days, or more than 28 days. The dose reduction during a drug holiday is, by way of example only, by 10%-100%, including by way of example only 10%, 15%, 20%, 25%, 30%, 35%, 40%, 45%, 50%, 55%, 60%, 65%, 70%, 75%, 80%, 85%, 90%, 95%, and 100%. In certain embodiments, the dose of drug being administered may be temporarily reduced or temporarily suspended for a certain length of time (i.e., a "drug diversion"). In specific embodiments, the length of the drug diversion is between 2 days and 1 year, including by way of example only, 2 days, 3 days, 4 days, 5 days, 6 days, 7 days, 10 days, 12 days, 15 days, 20 days, 28 days, or more than 28 days. The dose reduction during a drug diversion is, by way of example only, by 10%-100%, including by way of example only 10%, 15%, 20%, 25%, 30%, 35%, 40%, 45%, 50%, 55%, 60%, 65%, 70%, 75%, 80%, 85%, 90%, 95%, and 100%. After a suitable length of time, the normal dosing schedule is optionally reinstated.

In some embodiments, once improvement of the patient's conditions has occurred, a maintenance dose is administered if necessary. Subsequently, in specific embodiments, the dosage or the frequency of administration, or both, is reduced, as a function of the symptoms, to a level at which the improved disease, disorder or condition is retained. In certain embodiments, however, the patient requires intermittent treatment on a long-term basis upon any recurrence of symptoms.

Toxicity and therapeutic efficacy of such therapeutic regimens are determined by standard pharmaceutical procedures in cell cultures or experimental animals, including, but not limited to, the determination of the LD50 and the ED50. The dose ratio between the toxic and therapeutic effects is the therapeutic index and it is expressed as the ratio between LD50 and ED50. In certain embodiments, the data obtained from cell culture assays and animal studies are used in formulating the therapeutically effective daily dosage range and/or the therapeutically effective unit dosage amount for use in mammals, including humans. In some embodiments, the daily dosage amount of the therapeutic agent described herein lies within a range of circulating concentrations that include the ED50 with minimal toxicity. In certain embodiments, the daily dosage range and/or the unit dosage amount varies within this range depending upon the dosage form employed and the route of administration utilized.

Additional Therapeutic Agent

A therapeutic agent may be used alone or in combination with an additional therapeutic agent. The therapeutic agents may be administered together or sequentially. The combination therapies may be administered within the same day, or may be administered one or more days, weeks, months, or years apart. In some cases, a therapeutic agent provided herein is administered if the subject is determined to be non-responsive to a first line of therapy, e.g., such as TNF inhibitor. Such determination may be made by treatment with the first line therapy and monitoring of disease state and/or diagnostic determination that the subject would be non-responsive to the first line therapy.

In some embodiments, the additional therapeutic agent comprises an anti-TNF therapy, e.g., an anti-TNFα therapy. In some embodiments, the additional therapeutic agent comprises a second-line treatment to an anti-TNF therapy. In some embodiments, the additional therapeutic agent comprises an immunosuppressant, or a class of drugs that suppress, or reduce, the strength of the immune system. In some embodiments, the immunosuppressant is an antibody. Non-limiting examples of immunosuppressant therapeutic agents include STELARA® (ustekinumab) azathioprine (AZA), 6-mercaptopurine (6-MP), methotrexate, cyclosporin A. (CsA).

In some embodiments, the additional therapeutic agent comprises a selective anti-inflammatory drug, or a class of drugs that specifically target pro-inflammatory molecules in the body. In some embodiments, the anti-inflammatory drug comprises an antibody. In some embodiments, the anti-inflammatory drug comprises a small molecule. Non-limiting examples of anti-inflammatory drugs include vedolizumab (ENTYVIO®), corticosteroids, aminosalicylates, mesalamine, balsalazide (Colazal®) and olsalazine (Dipentum®).

In some embodiments, the additional therapeutic agent comprises a stem cell therapy. The stem cell therapy may be embryonic or somatic stem cells. The stem cells may be isolated from a donor (allogeneic) or isolated from the subject (autologous). The stem cells may be expanded adipose-derived stem cells (eASCs), hematopoietic stem cells (HSCs), mesenchymal stem (stromal) cells (MSCs), or induced pluripotent stem cells (iPSCs) derived from the cells of the subject. In some embodiments, the therapeutic agent comprises Cx601/Alofisel® (darvadstrocel).

In some embodiments, the additional therapeutic agent comprises a small molecule. The small molecule may be used to treat inflammatory diseases or conditions, or fibrostenonic or fibrotic disease. Non-limiting examples of small molecules include Otezla® (apremilast), alicaforsen, or ozanimod (RPC-1063).

The additional therapeutic agent may comprise an antimycotic agent. In some instances, the antimycotic agent comprises an active agent that inhibits growth of a fungus. In some instances, the antimycotic agent comprises an active agent that kills a fungus. In some embodiments, the antimycotic agent comprises polyene, an azole, an echinocandin, an flucytosine, an allylamine, a tolnaftate, or griseofulvin, or a combination thereof. In other embodiments, the azole comprises triazole, imidazole, clotrimazole, ketoconazole, itraconazole, terconazole, oxiconazole, miconazole, econazole, tioconazole, voriconazole, fluconazole, isavuconazole, itraconazole, pramiconazole, ravuconazole, or posaconazole. In some other embodiments, the polyene comprises amphotericin B, nystatin, or natamycin. In yet other embodiments, the echinocandin comprises caspofungin, anidulafungin, or micafungin. In various other embodiments, the allylamine comprises naftifine or terbinafine.

The additional therapeutic agent may comprise an agonist or an antagonist of therapeutic target. Non-limiting therapeutic targets include Mitogen-Activated Protein Kinase Kinase Kinase Kinase 4 (MAP4K4), Prostaglandin E Receptor 4 (PTGER4), Interleukin 18 Receptor 1 (IL18R1), Interleukin 18 Receptor Accessory Protein (IL18RAP), Adenylate Cyclase 7 (ADCY7), B Lymphoid Tyrosine Kinase (BLK), G Protein-Coupled Receptor 65 (GPR65), Sprouty Related EVH1 Domain Containing 2 (SPRED2), and Src Kinase Associated Phosphoprotein 2 (SKAP2). Non-limiting examples of MAP4K4 modulators include GNE-220 and PF-6260933. Non-limiting examples of PTGER4 modulators include grapiprant (CJ-023,423), ONO-AE3-208, GW627368X, AH23848, ONO-AE2-227, ONO-AE1-734, AGN205203, rivenprost (ONO-4819), CJ-023,423, and BGC20-1531. Exemplary modulators of PFKFB3 include, but are not limited to 3-(3-pyridinyl)-1-(4-pyridinyl)-2-propen-1-one (3P0), 1-(4-pyridinyl)-3-(2-quinolinyl)-2-propen-1-one (PFK15), 5-triazolo-2-arylpyridazinone,125 1-(3-pyridinyl)-3-(2-quinolinyl)-2-propen-1-one (PQP), 126 5, 6, 7, 8-tetrahydroxy-2-(4-hydroxyphenyl) chrome-4-one (N4A), and 7, 8-dihydroxy-3-(4-hydroxyphenyl) chromen-4-one (YN1). Non-limiting modulators of ADCY7 include forskolin and colforsin daropate. Non-limiting examples of GPR65 modulators include BTB09089 (3-[(2,4-dichlorophenyl)methylsulfanyl]-1,6-dimethylpyridazino[4,5-e][1,3,4]thiadiazin-5-one), and ZINC62678696.

In some embodiments, the therapeutic agent comprises an agonist of Janus Kinase 1 (JAK1). Non-limiting examples of JAK1 inhibitors include Ruxolitinib (INCB018424), S-Ruxolitinib (INCB018424), Baricitinib (LY3009104, INCB028050), Filgotinib (GLPG0634), Momelotinib (CYT387), Cerdulatinib (PRT062070, PRT2070), LY2784544, NVP-BSK805, 2HC1, Tofacitinib (CP-690550, Tasocitinib), XL019, Pacritinib (SB1518), or ZM 39923 HCl.

The therapeutic agent targeting the above genes or gene expression products may be an antibody or antigen binding fragment thereof. The therapeutic agent may be a small molecule. The therapeutic agent may be a peptide or a protein. The therapeutic agent may be an agonist, or partial agonist. The therapeutic agent may be an allosteric modulator, such as a positive allosteric modulator (PAM). The therapeutic agent may be an antagonist, or partial antagonist. The therapeutic agent may be an inverse agonist. The therapeutic agent may be a negative allosteric modulator (NAM).

Disclosed herein are additional therapeutic agents comprising modulators of Receptor Interacting Serine/Threonine Kinase 2 (RIPK2) (Entrez Gene ID: 8767) activity or expression that are useful for the treatment of an inflammatory, fibrotic, and/or fibrostenotic disease or condition. In some embodiments, the inflammatory disease comprises inflammatory bowel disease (IBD), Crohn's disease (CD), and/or ulcerative colitis (UC). In some embodiments, a modulator of RIPK2 activity or expression comprises an antagonist or a partial antagonist of RIPK2. In some embodiments, the RIPK2 antagonist or partial antagonist comprises an antibody or antigen-binding fragment, or a small molecule.

In some embodiments, the RIPK2 antagonist or partial antagonist comprises a type I RIPK2 inhibitor effective to bind to the ATP binding pocket of an active conformation of the RIPK2 kinase domain. In some embodiments, the RIPK2 antagonist or partial antagonist comprises a type I½ RIPK2 inhibitor effective to bind to the ATP binding pocket of an inactive conformation of the RIPK2 kinase domain without displacing the RIPK2 kinase activation segment. In some embodiments, the RIPK2 antagonist or partial antagonist comprises a type II RIPK2 inhibitor effective to displace a RIPK2 kinase activation segment. In some embodiments, the RIPK2 antagonist or partial antagonist comprises a type III RIPK2 inhibitor effective to bind an allosteric site of RIPK2 located in the cleft between the small and large lobes adjacent to the ATP binding pocket. In some embodiments, the RIPK2 antagonist or partial antagonist comprises a type IV RIPK2 inhibitor effective to bind an allosteric site of RIPK2 located outside of the cleft and the phosphoacceptor region. In some embodiments, the RIPK2 antagonist or partial antagonist comprises a type V RIPK2 inhibitor effective to span two regions of the RIPK2 kinase domain. In some embodiments, the RIPK2 antagonist or partial antagonist comprises a type VI RIPK2 inhibitor effective to form a covalent adduct with RIPK2. In some embodiments, the RIPK2 antagonist or partial antagonist comprises a RIPK2 inhibitor effective to inhibit RIPK2 ubiquitination. In some embodiments, the RIPK2 antagonist or partial antagonist comprises a RIPK2 inhibitor effective to inhibit RIPK2 autophosphorylation. In some embodiments, the RIPK2 antagonist or partial antagonist comprises a RIPK2 inhibitor effective to block NOD-dependent tumor necrosis factor production without affecting lipopolysaccharide-dependent pathways. In some embodiments, the RIPK2 antagonist or partial antagonist comprises ponatinib, sorafenib, regorafenib, gefitinib, or erlotinib. In some embodiments, the RIPK2 antagonist or partial antagonist comprises GSK2983559, GSK583, Inhibitor 7, Biaryl Urea, CSR35, CSLP37, CSLP43, RIPK2 inhibitor 1, CS6, PP2, WEHI- 345, SB203580, OD36, OD38, RIPK2-IN-1, or RIPK2-IN-2, or any combination thereof.

Disclosed herein, are antagonists or partial antagonists of RIPK2 having a structure of Formula (I) or a pharmaceutically acceptable salt or isotopic variant thereof:

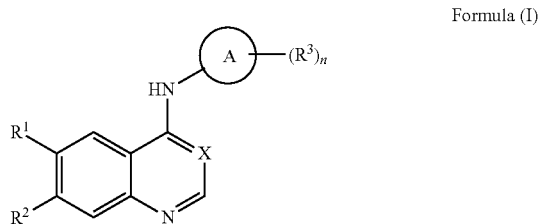

Formula (I)

wherein

Ring A is $C_{3-8}$cycloalkyl, $C_{2-9}$heterocycloalkyl, $C_{2-9}$heteroaryl, or 6- to 10-membered aryl;

X is N or $CR^4$;

$R^1$ and $R^2$ are independently —H, halogen, —OH, —$OR^5$, —CN, —$N(R^6)_2$, —$NR^6C(O)R^5$, —$C(O)OR^5$, —$C(O)N(R^6)_2$, $C_{1-6}$alkyl, $C_{2-6}$alkenyl, $C_{2-6}$alkynyl, $C_{3-8}$cycloalkyl, —$C_{1-6}$alkyl-OH, —$C_{1-6}$alkyl-$OR^5$, —$C_{1-6}$alkyl-$N(R^6)_2$, —O—$C_{1-6}$alkyl, —O—$C_{1-6}$alkyl-OH, —O—$C_{1-6}$alkyl-$OR^5$, —O—$C_{1-6}$alkyl-$N(R^6)_2$, or —$S(=O)_2R^5$;

each $R^3$ is independently —H, halogen, —$NO_2$, —CN, —OH, —$OR^5$, —$SR^5$, —$N(R^6)_2$, —$S(O)R^5$, —$S(=O)_2R^5$, —$NR^6S(=O)_2R^5$, —$S(=O)_2N(R^6)_2$, —$C(O)R^5$, —$C(O)OR^5$, —$OC(O)R^5$, —$C(O)N(R^6)_2$, —$OC(O)N(R^6)_2$, —$NR^6C(O)N(R^6)_2$, —$NR^6C(O)R^5$, —$NR^6C(O)OR^5$, $C_{1-6}$alkyl, $C_{2-6}$alkenyl, $C_{2-6}$alkynyl, $C_{1-6}$haloalkyl, $C_{1-6}$heteroalkyl, —O—$C_{1-6}$alkyl, $C_{3-8}$cycloalkyl, $C_{2-9}$heterocycloalkyl, $C_{2-9}$heteroaryl, 6- to 10-membered aryl, or —O-phenyl, wherein each alkyl, haloalkyl, heteroalkyl, cycloalkyl, heterocycloalkyl, aryl, and heteroaryl is optionally substituted with one or more $R^7$;

$R^4$ is —H, halogen, $C_{1-6}$alkyl, $C_{2-6}$alkenyl, $C_{2-6}$alkynyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, or —$C_{1-6}$alkyl-$C_{2-9}$heteroaryl, wherein the alkyl, haloalkyl, cycloalkyl, phenyl, heteroaryl, and heterocycloalkyl are optionally substituted;

each $R^5$ is independently —H, $C_{1-6}$alkyl, $C_{2-6}$alkenyl, $C_{2-6}$alkynyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, or —$C_{1-6}$alkyl-$C_{2-9}$heteroaryl;

each $R^6$ is independently —H, $C_{1-6}$alkyl, $C_{2-6}$alkenyl, $C_{2-6}$alkynyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, or $C_{2-9}$heteroaryl; or two $R^6$ substituents are taken together with the nitrogen atom to which they are attached to form a 5- or 6-membered heterocycle; and $R^7$ is —H, halogen, $C_{1-6}$alkyl, $C_{2-6}$alkenyl, $C_{2-6}$alkynyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, or —$C_{1-6}$alkyl-$C_{2-9}$heteroaryl; and n is 0, 1, 2, 3, 4, or 5.

In some embodiments of a compound of Formula (I), Ring A is $C_{3-8}$cycloalkyl, $C_{2-9}$heterocycloalkyl, $C_{2-9}$heteroaryl, or 6- to 10-membered aryl. In some embodiments of a compound of Formula (I), Ring A is $C_{3-7}$heteroaryl or 6-membered aryl. In some embodiments of a compound of Formula (I), Ring A is pyrrazolyl. In some embodiments of a compound of Formula (I), Ring A is $C_7$heteroaryl. In some embodiments of a compound of Formula (I), Ring A is phenyl.

In some embodiments, for a compound of Formula (I), X is N or $CR^4$. In some embodiments, for a compound of Formula (I), X is N or CH. In some embodiments, for a compound of Formula (I), X is N. In some embodiments, for a compound of Formula (I), X is CH.

In some embodiments, for a compound of Formula (I), $R^1$ is —H, halogen, —OH, —CN, —$N(R^6)_2$, —$NR^6C(O)R^5$, —$C(O)OR^5$, —$C(O)N(R^6)_2$, $C_{1-6}$alkyl, $C_{2-6}$alkenyl, $C_{2-6}$alkynyl, $C_{3-8}$cycloalkyl, —$C_{1-6}$alkyl-OH, —$C_{1-6}$alkyl-$OR^5$, —$C_{1-6}$alkyl-$N(R^6)_2$, —O—$C_{1-6}$alkyl, —O—$C_{1-6}$alkyl-OH, —O—$C_{1-6}$alkyl-$OR^5$, —O—$C_{1-6}$alkyl-$N(R^6)_2$, or —$S(=O)_2R^5$. In some embodiments, for a compound of Formula (I), $R^1$ is $C_{1-6}$alkyl, $C_{2-6}$alkenyl, —$C_{1-6}$alkyl-OH, —$C_{1-6}$alkyl-$OR^5$, —$C_{1-6}$alkyl-$N(R^6)_2$, —O—$C_{1-6}$alkyl, —O—$C_{1-6}$alkyl-OH, —O—$C_{1-6}$alkyl-$OR^5$, —O—$C_{1-6}$alkyl-$N(R^6)_2$, or —$S(=O)_2R^5$. In some embodiments, for a compound of Formula (I), $R^1$ is —O—$C_{1-6}$alkyl, —O—$C_{1-6}$alkyl-$OR^5$, —O—$C_{1-6}$alkyl-$N(R^6)_2$, or —$S(=O)_2R^5$. In some embodiments, for a compound of Formula (I), $R^1$ is —O—$C_{1-6}$alkyl. In some embodiments, for a compound of Formula (I), $R^1$ is —$OCH_3$. In some embodiments, for a compound of Formula (I), $R^1$ is —O—$C_{1-6}$alkyl-$OR^5$. In some embodiments, for a compound of Formula (I), $R^1$ is —$OCH_2CH_2OCH_3$. In some embodiments, for a compound of Formula (I), $R^1$ is —O—$C_{1-6}$alkyl-$N(R^6)_2$. In some embodiments, for a compound of Formula (I), $R^1$ is —O$CH_2CH_2CH_2$morpholine. In some embodiments, for a compound of Formula (I), $R^1$ is —$S(=O)_2R^5$. In some embodiments, for a compound of Formula (I), $R^1$ is —$S(=O)_2$tert-butyl.

In some embodiments, for a compound of Formula (I), $R^2$ is —H, halogen, —OH, —CN, —$N(R^6)_2$, —$NR^6C(O)R^5$, —$C(O)OR^5$, —$C(O)N(R^6)_2$, $C_{1-6}$alkyl, $C_{2-6}$alkenyl, $C_{2-6}$alkynyl, $C_{3-8}$cycloalkyl, —$C_{1-6}$alkyl-OH, —$C_{1-6}$alkyl-$OR^5$, —$C_{1-6}$alkyl-$N(R^6)_2$, —O—$C_{1-6}$alkyl, —O—$C_{1-6}$alkyl-OH, —O—$C_{1-6}$alkyl-$OR^5$, —O—$C_{1-6}$alkyl-$N(R^6)_2$, or —$S(=O)_2R^5$. In some embodiments, for a compound of Formula (I), $R^2$ is —H, —O—$C_{1-6}$alkyl, —O—$C_{1-6}$alkyl-$OR^5$, or —O—$C_{1-6}$alkyl-OH. In some embodiments, for a compound of Formula (I), $R^2$ is —H. In some embodiments, for a compound of Formula (I), $R^2$ is —O—$C_{1-6}$alkyl. In some embodiments, for a compound of Formula (I), $R^2$ is —$OCH_3$. In some embodiments, for a compound of Formula (I), $R^2$ is —O—$C_{1-6}$alkyl-$OR^5$. In some embodiments, for a compound of Formula (I), $R^2$ is —$OCH_2CH_2OCH_3$. In some embodiments, for a compound of Formula (I), $R^2$ is —O—$C_{1-6}$alkyl-OH. In some embodiments, for a compound of Formula (I), $R^2$ is —$OCH_2CH_2OH$.

In some embodiments, for a compound of Formula (I), $R^3$ is —H, halogen, —$NO_2$, —CN, —OH, —$OR^5$, —$SR^5$, —$N(R^6)_2$, —$S(O)R^5$, —$S(=O)_2R^5$, —$NR^6S(=O)_2R^5$, —$S(=O)_2N(R^6)_2$, —$C(O)R^5$, —$C(O)OR^5$, —$OC(O)R^5$, —$C(O)N(R^6)_2$, —$OC(O)N(R^6)_2$, —$NR^6C(O)N(R^6)_2$, —$NR^6C(O)R^5$, —$NR^6C(O)OR^5$, $C_{1-6}$alkyl, $C_{2-6}$alkenyl, $C_{2-6}$alkynyl, $C_{1-6}$haloalkyl, $C_{1-6}$heteroalkyl, —O—$C_{1-6}$alkyl, $C_{3-8}$cycloalkyl, $C_{2-9}$heterocycloalkyl, $C_{2-9}$heteroaryl, 6- to 10-membered aryl, or —O-phenyl, wherein each alkyl, haloalkyl, heteroalkyl, cycloalkyl, heterocycloalkyl, aryl, and heteroaryl is optionally substituted with one or more $R^7$. In some embodiments, for a compound of Formula (I), $R^3$ is —H, halogen, C$_{1-6}$alkyl, C$_{2-6}$alkynyl, or —O-phenyl. In some embodiments, for a compound of Formula (I), R$^3$ is —H. In some embodiments, for a compound of Formula (I), R$^3$ is —Cl. In some embodiments, for a compound of Formula (I), R$^3$ is —F. In some embodiments, for a compound of Formula (I), R$^3$ is —CH$_3$. In some embodiments, for a compound of Formula (I), R$^3$ is —CCH. In some embodiments, for a compound of Formula (I), R$^3$ is —O-phenyl.

In some embodiments, for a compound of Formula (I), n is 0, 1, 2, or 3. In some embodiments, for a compound of Formula (I), n is 1, 2, or 3. In some embodiments, for a compound of Formula (I), n is 1 or 2. In some embodiments, for a compound of Formula (I), n is 0. In some embodiments, for a compound of Formula (I), n is 1. In some embodiments, for a compound of Formula (I), n is 2. In some embodiments, for a compound of Formula (I), n is 3.

Disclosed herein, are antagonists or partial antagonists of RIPK2 having a structure of Formula (Ia) or a pharmaceutically acceptable salt or isotopic variant thereof:

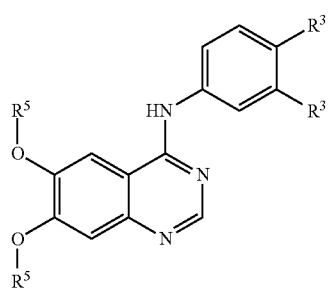

Formula (Ia)

wherein;
each R$^3$ is independently —H, halogen, —C≡CH, or —O-aryl; and
each R$^5$ is independently C$_{1-6}$ alkyl, —C$_{1-6}$alkyl-O—C$_{1-6}$ alkyl, or —C$_{1-6}$alkyl-heterocycloalkyl.

Disclosed herein, are antagonists or partial antagonists of RIPK2 having a structure of Formula (Ia) or a pharmaceutically acceptable salt or isotopic variant thereof:

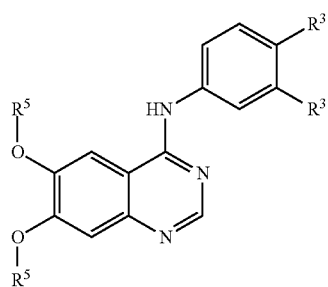

Formula (Ia)

wherein;
each R$^3$ is independently —H, —Cl, —F, —C≡CH, or —O-phenyl; and
each R$^5$ is independently —CH$_3$, —CH$_2$CH$_2$OCH$_3$, or —CH$_2$CH$_2$CH$_2$morpholine.

Disclosed herein, are antagonists or partial antagonists of RIPK2 having a structure of Formula (Ib) or a pharmaceutically acceptable salt or isotopic variant thereof:

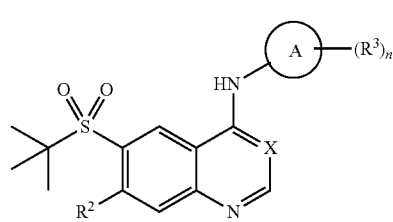

Formula (Ib)

wherein;
Ring A is C$_{3-7}$heteroaryl;
X is N or CH;
R$^2$ is —H, —OC$_{1-6}$alkyl, or —O—C$_{1-6}$alkyl-OH;
each R$^3$ is independently —H, —C$_{1-6}$alkyl, or halogen; and
n is 0, 1, or 2.

Disclosed herein, are antagonists or partial antagonists of RIPK2 having a structure of Formula (Ib) or a pharmaceutically acceptable salt or isotopic variant thereof:

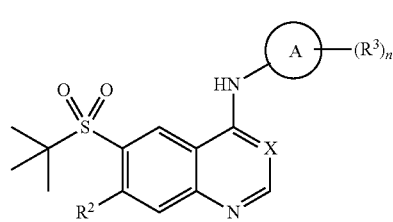

Formula (Ib)

wherein;
Ring A is C$_{3-7}$heteroaryl;
X is N or CH;
R$^2$ is —H, —OCH$_3$, or —OCH$_2$CH$_2$OH;
each R$^3$ is independently —H, —CH$_3$, or —F; and
n is 0, 1, or 2.

In some embodiments a compound of Formula (I) or a pharmaceutically acceptable salt or isotopic variant thereof has the structure of:

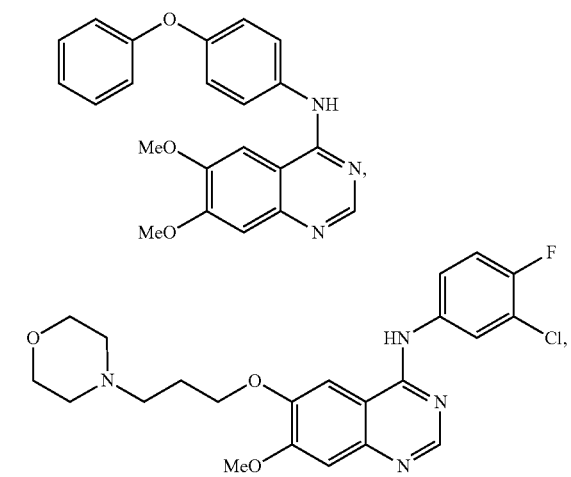

-continued

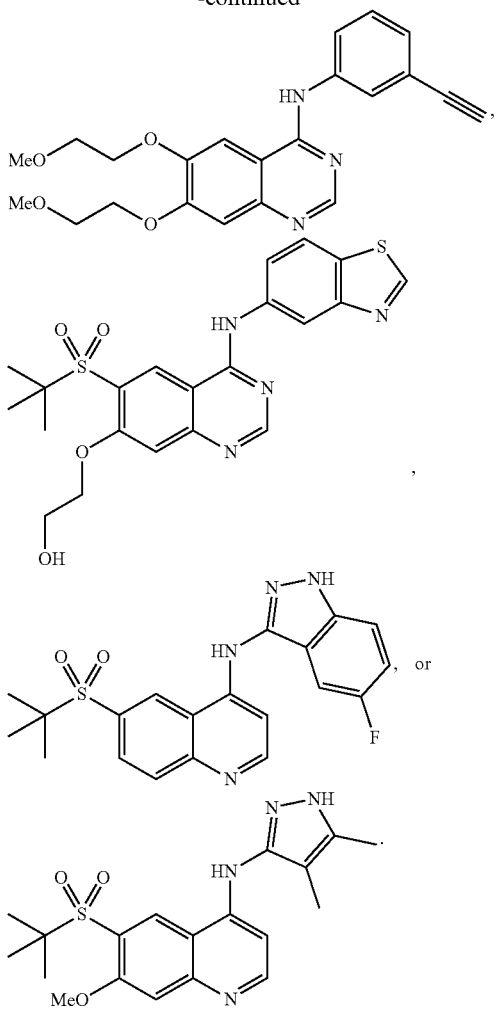

Disclosed herein, are antagonists or partial antagonists of RIPK2 having a structure of Formula (II) or a pharmaceutically acceptable salt or isotopic variant thereof:

Formula (II)

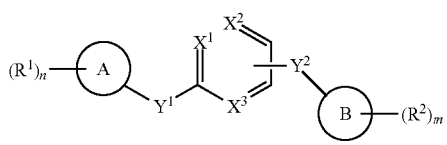

wherein

Rings A and B are independently $C_{3-8}$cycloalkyl, $C_{2-9}$heterocycloalkyl, $C_{2-9}$heteroaryl, or 6- to 10-membered aryl;

$X^1$, $X^2$, and $X^3$ are independently N or $CR^4$;

$Y^1$ and $Y^2$ are independently a bond, —O—, —S—, —C($R^5$)$_2$, —$NR^6$C(O)—, —C(O)$NR^6$—, or —$NR^6$C(O)$NR^6$—;

each $R^1$ and $R^2$ is independently —H, halogen, —NO$_2$, —CN, —OH, —OR$^5$, —SR$^5$, —N(R$^6$)$_2$, —S(O)R$^5$, —S(=O)$_2$R$^5$, —NR$^6$S(=O)$_2$R$^5$, —S(=O)$_2$N(R$^6$)$_2$, —SCH$_2$C(O)OR$^5$, —C(O)R$^5$, —C(O)OR$^5$, —OC(O)R$^5$, —C(O)N(R$^6$)$_2$, —OC(O)N(R$^6$)$_2$, —NR$^6$C(O)N(R$^6$)$_2$, —NR$^6$C(O)R$^5$, —NR$^6$C(O)OR$^5$, $C_{1-6}$alkyl, $C_{2-6}$alkenyl, $C_{2-6}$alkynyl, $C_{1-6}$haloalkyl, $C_{1-6}$heteroalkyl, —O—$C_{1-6}$alkyl, $C_{3-8}$cycloalkyl, $C_{2-9}$heterocycloalkyl, $C_{2-9}$heteroaryl, 6- to 10-membered aryl, or —O-phenyl, wherein each alkyl, haloalkyl, heteroalkyl, cycloalkyl, heterocycloalkyl, aryl, and heteroaryl is optionally substituted with one or more $R^7$;

each $R^4$ is independently —H, halogen, —N(R$^6$)$_2$, —NO$_2$, $C_{1-6}$alkyl, $C_{2-6}$alkenyl, $C_{2-6}$alkynyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, or —$C_{1-6}$alkyl-$C_{2-9}$heteroaryl, wherein the alkyl, haloalkyl, cycloalkyl, phenyl, heteroaryl, and heterocycloalkyl are optionally substituted;

each $R^5$ is independently —H, $C_{1-6}$alkyl, $C_{2-6}$alkenyl, $C_{2-6}$alkynyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, or —$C_{1-6}$alkyl-$C_{2-9}$heteroaryl;

each $R^6$ is independently —H, $C_{1-6}$alkyl, $C_{2-6}$alkenyl, $C_{2-6}$alkynyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, or $C_{2-9}$heteroaryl; or two $R^6$ are taken together with the nitrogen atom to which they are attached to form a 5- or 6-membered heterocycle; and $R^7$ is —H, halogen, $C_{1-6}$alkyl, $C_{2-6}$alkenyl, $C_{2-6}$alkynyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, or —$C_{1-6}$alkyl-$C_{2-9}$heteroaryl; and m and n are each independently 0, 1, 2, 3, 4, or 5.

In some embodiments, for a compound of Formula (II), Rings A and B are independently $C_{3-8}$cycloalkyl, $C_{2-9}$heterocycloalkyl, $C_{2-9}$heteroaryl, or 6- to 10-membered aryl. In some embodiments, for a compound of Formula (II), Rings A and B are independently $C_{2-9}$heteroaryl or 6- to 10-membered aryl. In some embodiments, for a compound of Formula (II), Ring A is phenyl. In some embodiments, for a compound of Formula (II), Ring A is pyridyl. In some embodiments, for a compound of Formula (II), Ring A is furanyl. In some embodiments, for a compound of Formula (II), Ring B is phenyl. In some embodiments, for a compound of Formula (II), Ring B is pyrrazolyl. In some embodiments, for a compound of Formula (II), Ring B is pyridyl. In some embodiments, for a compound of Formula (II), Ring B is isoxazolyl. In some embodiments, for a compound of Formula (II), Ring A is phenyl and Ring B is pyrrazolyl. In some embodiments, for a compound of Formula (II), Ring A is phenyl and Ring B is phenyl. In some embodiments, for a compound of Formula (II), Ring A is phenyl and Ring B is pyridyl. In some embodiments, for a compound of Formula (II), Ring A is pyridyl and Ring B is phenyl. In some embodiments, for a compound of Formula (II), Ring A is pyridyl and Ring B is isoxazolyl. In some embodiments, for a compound of Formula (II), Ring A is isoxazoylyl and Ring B is pyridyl. In some embodiments, for a compound of Formula (II), Ring A is furanyl and Ring B is phenyl.

In some embodiments, for a compound of Formula (II), $X^1$, $X^2$, and $X^3$ are independently N or $CR^4$. In some embodiments, for a compound of Formula (II), $X^1$ is CH. In some embodiments, for a compound of Formula (II), $X^1$ is CF. In some embodiments, for a compound of Formula (II), $X^1$ is CCH$_3$. In some embodiments, for a compound of Formula (II), $X^1$ is CNH$_2$. In some embodiments, for a compound of Formula (II), $X^1$ is N. In some embodiments, for a compound of Formula (II), $X^2$ is CH. In some embodiments, for a compound of Formula (II), $X^2$ is CF. In some embodiments, for a compound of Formula (II), $X^2$ is N. In some embodiments, for a compound of Formula (II), $X^2$ is C—N-methylpyrazine. In some embodiments, for a compound of Formula (II), $X^3$ is CH. In some embodiments, for a compound of Formula (II), $X^3$ is N. In some embodiments, for a compound of Formula (II), $X^1$ is CF and $X^2$ and $X^3$ are CH. In some embodiments, for a compound of Formula (II), $X^2$ is CF and $X^1$ and $X^3$ are CH. In some embodiments, for a compound of Formula (II), $X^1$, $X^2$, and $X^3$ are CH. In some embodiments, for a compound of Formula (II), $X^1$ is $CCH_3$ and $X^2$ and $X^3$ are CH. In some embodiments, for a compound of Formula (II), $X^1$ is $CNH_2$, $X^2$ is N, and $X^3$ is CH. In some embodiments, for a compound of Formula (II), $X^2$ is C—N-methylpyrazine and $X^1$ and $X^3$ are N.

In some embodiments, for a compound of Formula (II), $Y^1$ and $Y^2$ are independently a bond, —O—, —S—, —$C(R^5)_2$, —$NR^6$—, —$NR^6C(O)$—, —$C(O)NR^6$—, or —$NR^6C(O)NR^6$—. In some embodiments, for a compound of Formula (II), $Y^1$ is —$NR^6C(O)$—. In some embodiments, for a compound of Formula (II), $Y^1$ is —O—. In some embodiments, for a compound of Formula (II), $Y^1$ is —$NR^6C(O)NR^6$—. In some embodiments, for a compound of Formula (II), $Y^1$ is a bond. In some embodiments, for a compound of Formula (II), $Y^1$ is —$NR^6$—. In some embodiments, for a compound of Formula (II), $Y^2$ is —$NR^6C(O)$—. In some embodiments, for a compound of Formula (II), $Y^2$ is —O—. In some embodiments, for a compound of Formula (II), $Y^2$ is —$NR^6C(O)NR^6$—. In some embodiments, for a compound of Formula (II), $Y^2$ is a bond. In some embodiments, for a compound of Formula (II), $Y^1$ is —S—. In some embodiments, for a compound of Formula (II), $Y^1$ and $Y^2$ are —NHC(O)—. In some embodiments, for a compound of Formula (II), $Y^1$ is —O— and $Y^2$ is —NHC(O)NH—. In some embodiments, for a compound of Formula (II), $Y^1$ is —NHC(O)NH— and $Y^2$ is —O—. In some embodiments, for a compound of Formula (II), $Y^1$ and $Y^2$ are bonds. In some embodiments, for a compound of Formula (II), $Y^1$ is —NH— and $Y^2$ is —S—.

In some embodiments, for a compound of Formula (II), $R^1$ is —H, halogen, —$NO_2$, —CN, —OH, —$OR^5$, —$SR^5$, —$N(R^6)_2$, —$S(O)R^5$, —$S(=O)_2R^5$, —$NR^6S(=O)_2R^5$, —$S(=O)_2N(R^6)_2$, —$C(O)R^5$, —$C(O)OR^5$, —$OC(O)R^5$, —$C(O)N(R^6)_2$, —$OC(O)N(R^6)_2$, —$NR^6C(O)N(R^6)_2$, —$NR^6C(O)R^5$, —$NR^6C(O)OR^5$, $C_{1-6}$alkyl, $C_{2-6}$alkenyl, $C_{2-6}$alkynyl, $C_{1-6}$haloalkyl, $C_{1-6}$heteroalkyl, —O—$C_{1-6}$alkyl, $C_{3-8}$cycloalkyl, $C_{2-9}$heterocycloalkyl, $C_{2-9}$heteroaryl, 6- to 10-membered aryl, or —O-phenyl, wherein each alkyl, haloalkyl, heteroalkyl, cycloalkyl, heterocycloalkyl, aryl, and heteroaryl is optionally substituted with one or more $R^7$. In some embodiments, for a compound of Formula (II), $R^1$ is —Cl. In some embodiments, for a compound of Formula (II), $R^1$ is —F. In some embodiments, for a compound of Formula (II), $R^1$ is —$C(O)NHCH_3$. In some embodiments, for a compound of Formula (II), $R^1$ is 2-methylpyrrazolyl. In some embodiments, for a compound of Formula (II), $R^1$ is N-methylimidazolyl. In some embodiments, for a compound of Formula (II), $R^1$ is tert-butyl. In some embodiments, for a compound of Formula (II), $R^1$ is —NHC(O)cyclopropyl. In some embodiments, for a compound of Formula (II), $R^1$ is —$SCH_2C(O)OH$. In some embodiments, for a compound of Formula (II), $R^1$ is —$OCH_3$. In some embodiments, for a compound of Formula (II), $R^1$ is —$NHS(=O)_2CH_2CH_2CH_3$.

In some embodiments, for a compound of Formula (II), $R^2$ is —H, halogen, —$NO_2$, —CN, —OH, —$OR^5$, —$SR^5$, —$N(R^6)_2$, —$S(O)R^5$, —$S(=O)_2R^5$, —$NR^6S(=O)_2R^5$, —$S(=O)_2N(R^6)_2$, —$C(O)R^5$, —$C(O)OR^5$, —$OC(O)R^5$, —$C(O)N(R^6)_2$, —$OC(O)N(R^6)_2$, —$NR^6C(O)N(R^6)_2$, —$NR^6C(O)N(R^6)_2$, —$NR^6C(O)R^5$, —$NR^6C(O)OR^5$, $C_{1-6}$alkyl, $C_{2-6}$alkenyl, $C_{2-6}$alkynyl, $C_{1-6}$haloalkyl, $C_{1-6}$heteroalkyl, —O—$C_{1-6}$alkyl, $C_{3-8}$cycloalkyl, $C_{2-9}$heterocycloalkyl, $C_{2-9}$heteroaryl, 6- to 10-membered aryl, or —O-phenyl, wherein each alkyl, haloalkyl, heteroalkyl, cycloalkyl, heterocycloalkyl, aryl, and heteroaryl is optionally substituted with one or more $R^7$. In some embodiments, for a compound of Formula (II), $R^2$ is —Cl. In some embodiments, for a compound of Formula (II), $R^2$ is —F. In some embodiments, for a compound of Formula (II), $R^2$ is —$C(O)NHCH_3$. In some embodiments, for a compound of Formula (II), $R^1$ is 2-methylpyrrazolyl. In some embodiments, for a compound of Formula (II), $R^1$ is N-methylimidazolyl. In some embodiments, for a compound of Formula (II), $R^2$ is —$CH_2$-(2-iso-propylimidazole). In some embodiments, for a compound of Formula (II), $R^2$ is tert-butyl. In some embodiments, for a compound of Formula (II), $R^2$ is —$CH_3$. In some embodiments, for a compound of Formula (II), $R^2$ is —$C(O)NHCH_3$. In some embodiments, for a compound of Formula (II), $R^2$ is pyrazinyl.

In some embodiments, for a compound of Formula (II), m is 1 or 2. In some embodiments, for a compound of Formula (II), m is 1. In some embodiments, for a compound of Formula (II), m is 2. In some embodiments, for a compound of Formula (II), n is 1 or 2. In some embodiments, for a compound of Formula (II), n is 1. In some embodiments, for a compound of Formula (II), n is 2.

Disclosed herein, are antagonists or partial antagonists of RIPK2 having a structure of Formula (IIa) or a pharmaceutically acceptable salt or isotopic variant thereof:

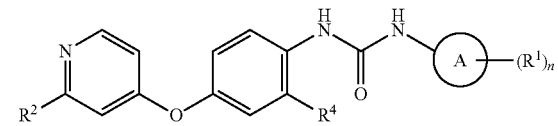

Formula (IIa)

wherein
Ring A is phenyl or isoxazolyl;
each $R^1$ is independently $C_{1-6}$alkyl, halogen, —$C_{1-6}$fluoroalkyl, or —S—$C_{1-6}$alkyl-C(O)OH;
$R^2$ is —H or —$C(O)NHCH_3$;
$R^4$ is —H or halogen; and
m is 1 or 2.

Disclosed herein, are antagonists or partial antagonists of RIPK2 having a structure of Formula (IIa) or a pharmaceutically acceptable salt or isotopic variant thereof:

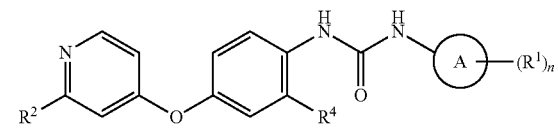

Formula (IIa)

wherein

Ring A is phenyl or isoxazolyl;

each $R^1$ is independently tert-butyl, —Cl, —F, —CF$_3$, or —SCH$_2$C(O)OH;

$R^2$ is —H or —C(O)NHCH$_3$;

$R^4$ is —H or halogen; and m is 1 or 2.

Disclosed herein, are antagonists or partial antagonists of RIPK2 having a structure of Formula (IIb) or a pharmaceutically acceptable salt or isotopic variant thereof:

Formula (IIb)

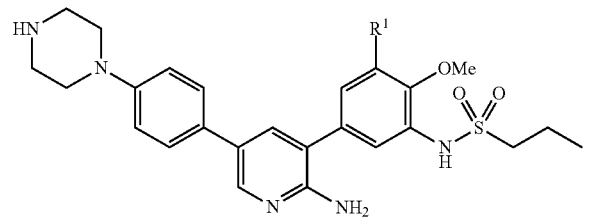

wherein $R^1$ is halogen or —OR$^5$.

In some embodiments a compound of Formula (II) or a pharmaceutically acceptable salt or isotopic variant thereof has the structure of:

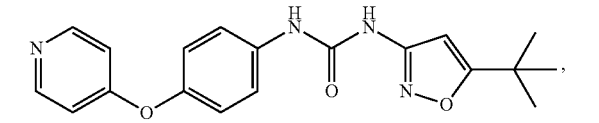

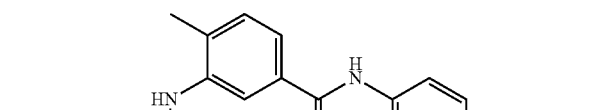

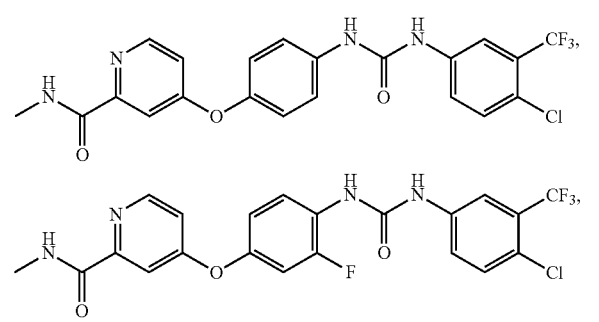

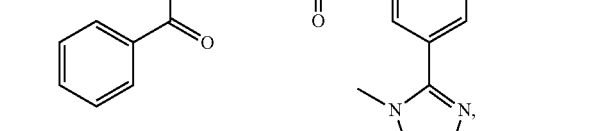

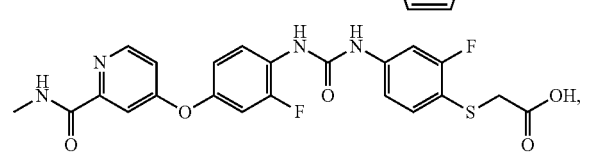

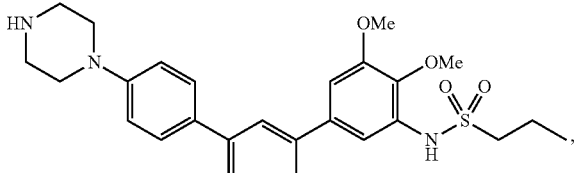

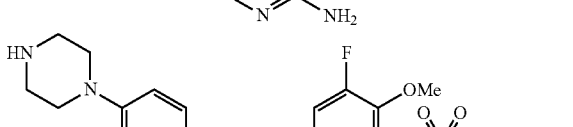

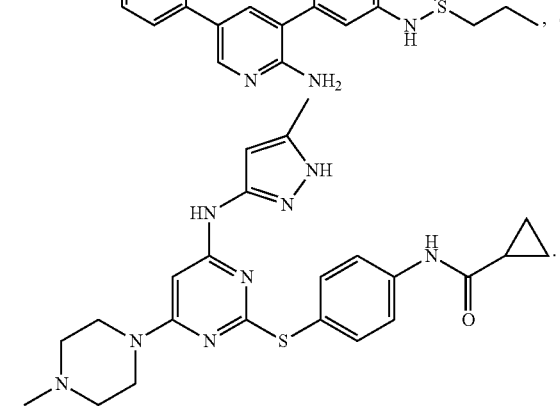

Disclosed herein, are antagonists or partial antagonists of RIPK2 having a structure of Formula (III) or a pharmaceutically acceptable salt or isotopic variant thereof:

Formula (III)

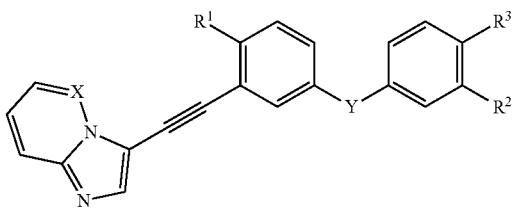

wherein

X is N or CR$^4$;

Y is a bond, —O—, —S—, —C(R$^5$)$_2$, —NR$^6$—, —NR$^6$C(O)—, —C(O)NR$^6$—, or —NR$^6$C(O)NR$^6$—;

$R^1$ is —H, halogen, —OH, —CN, —N(R$^6$)$_2$, —NR$^6$C(O)R$^5$, —C(O)OR$^5$, —C(O)N(R$^6$)$_2$, C$_{1-6}$alkyl, C$_{2-6}$alkenyl, C$_{2-6}$alkynyl, C$_{3-8}$cycloalkyl, —C$_{1-6}$alkyl-OH, —C$_{1-6}$alkyl-OR$^5$, —C$_{1-6}$alkyl-N(R$^6$)$_2$, —O—C$_{1-6}$alkyl, —O—C$_{1-6}$alkyl-OH, —O—C$_{1-6}$alkyl-OR$^5$, —O—C$_{1-6}$alkyl-N(R$^6$)$_2$, or —S(=O)$_2$R$^5$;

$R^2$ and $R^3$ are independently —H, halogen, —NO$_2$, —CN, —OH, —OR$^5$, —SR$^5$, —N(R$^6$)$_2$, —S(O)R$^5$, —S(=O)$_2$R$^5$, —NR$^6$S(=O)$_2$R$^5$, —S(=O)$_2$N(R$^6$)$_2$, —C(O)R$^5$, —C(O)OR$^5$, —OC(O)R$^5$, —C(O)N(R$^6$)$_2$, —OC(O)N(R$^6$)$_2$, —NR$^6$C(O)N(R$^6$)$_2$, —NR$^6$C(O)R$^5$, —NR$^6$C(O)OR$^5$, C$_{1-6}$alkyl, C$_{2-6}$alkenyl, C$_{2-6}$alkynyl, C$_{1-6}$haloalkyl, C$_{1-6}$heteroalkyl, —O—C$_{1-6}$alkyl, C$_{3-8}$cycloalkyl, C$_{2-9}$heterocycloalkyl, C$_{2-9}$heteroaryl, 6- to 10-membered aryl, or —O-phenyl, wherein each alkyl, haloalkyl, heteroalkyl, cycloalkyl, heterocycloalkyl, aryl, and heteroaryl is optionally substituted with one or more R$^7$; or R$^2$ and R$^3$ are taken together with the atoms to which they are attached to form an optionally substituted C$_{3-8}$cycloalkyl; and R$^4$ is hydrogen, halogen, —N(R$^6$)$_2$, —NO$_2$, C$_{1-6}$alkyl, C$_{2-6}$alkenyl, C$_{2-6}$alkynyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, C$_{2-9}$heterocycloalkyl, —C$_{1-6}$alkyl-C$_{2-9}$heterocycloalkyl, C$_{2-9}$heteroaryl, or —C$_{1-6}$alkyl-C$_{2-9}$heteroaryl, wherein the alkyl, haloalkyl, cycloalkyl, phenyl, heteroaryl, and heterocycloalkyl are optionally substituted;

R$^5$ is —H, C$_{1-6}$alkyl, C$_{2-6}$alkenyl, C$_{2-6}$alkynyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, C$_{2-9}$heterocycloalkyl, —C$_{1-6}$alkyl-C$_{2-9}$heterocycloalkyl, C$_{2-9}$heteroaryl, or —C$_{1-6}$alkyl-C$_{2-9}$heteroaryl;

each R$^6$ is independently —H, C$_{1-6}$alkyl, C$_{2-6}$alkenyl, C$_{2-6}$alkynyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, or C$_{2-9}$heteroaryl; or two R$^6$ substituents are taken together with the nitrogen atom to which they are attached to form a 5- or 6-membered heterocycle; and R$^7$ is —H, halogen, C$_{1-6}$alkyl, C$_{2-6}$alkenyl, C$_{2-6}$alkynyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, C$_{2-9}$heterocycloalkyl, —C$_{1-6}$alkyl-C$_{2-9}$heterocycloalkyl, C$_{2-9}$heteroaryl, or —C$_{1-6}$alkyl-C$_{2-9}$heteroaryl.

In some embodiments, for a compound of Formula (III), X is N or CR$^4$. In some embodiments, for a compound of Formula (III), X is N and CH. In some embodiments, for a compound of Formula (III), X is N. In some embodiments, for a compound of Formula (III), X is CH.

In some embodiments, for a compound of Formula (III), Y is a bond, —O—, —S—, —C(R$^5$)$_2$—NR$^6$—, —NR$^6$C(O)—, —C(O)NR$^6$—, or —NR$^6$C(O)NR$^6$—. In some embodiments, for a compound of Formula (III), Y is —NR$^6$C(O)— or —C(O)NR$^6$—. In some embodiments, for a compound of Formula (III), Y is —NHC(O)—. In some embodiments, for a compound of Formula (III), Y is —C(O)NH—.

In some embodiments, for a compound of Formula (III), R$^1$ is —H, halogen, —OH, —CN, —N(R$^6$)$_2$, —NR$^6$C(O)R$^5$, —C(O)OR$^5$, —C(O)N(R$^6$)$_2$, C$_{1-6}$alkyl, C$_{2-6}$alkenyl, C$_{2-6}$alkynyl, C$_{3-8}$cycloalkyl, —C$_{1-6}$alkyl-OH, —C$_{1-6}$alkyl-OR$^5$, —C$_{1-6}$alkyl-N(R$^6$)$_2$, —O—C$_{1-6}$alkyl, —O—C$_{1-6}$alkyl-OH, —O—C$_{1-6}$alkyl-OR$^5$, —O—C$_{1-6}$alkyl-N(R$^6$)$_2$, or —S(=O)$_2$R$^5$. In some embodiments, for a compound of Formula (III), R$^1$ is —H, halogen, —OH, —CN, —N(R$^6$)$_2$, C$_{1-6}$alkyl, C$_{2-6}$alkynyl, or C$_{3-8}$cycloalkyl. In some embodiments, for a compound of Formula (III), R$^1$ is C$_{1-6}$alkyl. In some embodiments, for a compound of Formula (III), R$^1$ is —CH$_3$. In some embodiments, for a compound of Formula (III), R$^1$ is tert-butyl.

In some embodiments, for a compound of Formula (III), R$^2$ is —H, halogen, —NO$_2$, —CN, —OH, —OR$^5$, —SR$^5$, —N(R$^6$)$_2$, —S(O)R$^5$, —S(=O)$_2$R$^5$, —NR$^6$S(=O)$_2$R$^5$, —S(=O)$_2$N(R$^6$)$_2$, —C(O)R$^5$, —C(O)OR$^5$, —OC(O)R$^5$, —C(O)N(R$^6$)$_2$, —OC(O)N(R$^6$)$_2$, —NR$^6$C(O)N(R$^6$)$_2$, —NR$^6$C(O)R$^5$, —NR$^6$C(O)OR$^5$, C$_{1-6}$alkyl, C$_{2-6}$alkenyl, C$_{2-6}$alkynyl, C$_{1-6}$haloalkyl, C$_{1-6}$heteroalkyl, —O—C$_{1-6}$alkyl, C$_{3-8}$cycloalkyl, C$_{2-9}$heterocycloalkyl, C$_{2-9}$heteroaryl, 6- to 10-membered aryl, or —O-phenyl, wherein each alkyl, haloalkyl, heteroalkyl, cycloalkyl, heterocycloalkyl, aryl, and heteroaryl is optionally substituted with one or more R$^7$, or R$^2$ and R$^3$ are taken together with the atoms to which they are attached to form an optionally substituted C$_{3-8}$cycloalkyl. In some embodiments, for a compound of Formula (III), R$^2$ is —H, halogen, —NO$_2$, —CN, —OH, —OR$^5$, C$_{1-6}$alkyl, C$_{1-6}$haloalkyl, C$_{1-6}$heteroalkyl, C$_{3-8}$cycloalkyl, C$_{2-9}$heterocycloalkyl, C$_{2-9}$heteroaryl, or 6- to 10-membered aryl, or R$^2$ and R$^3$ are taken together with the atoms to which they are attached to form an optionally substituted C$_{3-8}$cycloalkyl. In some embodiments, for a compound of Formula (III), R$^2$ is C$_{1-6}$alkyl, C$_{1-6}$haloalkyl, or C$_{3-8}$cycloalkyl, or R$^2$ and R$^3$ are taken together with the atoms to which they are attached to form an optionally substituted C$_{3-8}$cycloalkyl. In some embodiments, for a compound of Formula (III), R$^2$ is —CH$_3$, —CF$_3$, or cyclopropyl, or R$^2$ and R$^3$ are taken together with the atoms to which they are attached to form an optionally substituted C$_{3-8}$cycloalkyl. In some embodiments, for a compound of Formula (III), R$^2$ is —CH$_3$, —CF$_3$, or cyclopropyl. In some embodiments, for a compound of Formula (III), R$^2$ is —CH$_3$. In some embodiments, for a compound of Formula (III), R$^2$ is —CF$_3$. In some embodiments, for a compound of Formula (III), R$^2$ is cyclopropyl. In some embodiments, for a compound of Formula (III), R$^2$ and R$^3$ are taken together with the atoms to which they are attached to form a C$_5$ cycloalkyl. In some embodiments, for a compound of Formula (III), R$^2$ and R$^3$ are taken together with the atoms to which they are attached to form a C5 cycloalkyl substituted with an N-methylpiperazine.

In some embodiments, for a compound of Formula (III), R$^3$ is —H, halogen, —NO$_2$, —CN, —OH, —OR$^5$, —SR$^5$, —N(R$^6$)$_2$, —S(O)R$^5$, —S(=O)$_2$R$^5$, —NR$^6$S(=O)$_2$R$^5$, —S(=O)$_2$N(R$^6$)$_2$, —C(O)R$^5$, —C(O)OR$^5$, —OC(O)R$^5$, —C(O)N(R$^6$)$_2$, —OC(O)N(R$^6$)$_2$, —NR$^6$C(O)N(R$^6$)$_2$, —NR$^6$C(O)R$^5$, —NR$^6$C(O)OR$^5$, C$_{1-6}$alkyl, C$_{2-6}$alkenyl, C$_{2-6}$alkynyl, C$_{1-6}$haloalkyl, C$_{1-6}$heteroalkyl, —O—C$_{1-6}$alkyl, C$_{3-8}$cycloalkyl, C$_{2-9}$heterocycloalkyl, C$_{2-9}$heteroaryl, 6- to 10-membered aryl, or —O-phenyl, wherein each alkyl, haloalkyl, heteroalkyl, cycloalkyl, heterocycloalkyl, aryl, and heteroaryl is optionally substituted with one or more R$^7$, or R$^2$ and R$^3$ are taken together with the atoms to which they are attached to form an optionally substituted C$_{3-8}$cycloalkyl. In some embodiments, for a compound of Formula (III), R$^3$ is —H, halogen, —CN, —OR$^5$, —N(R$^6$)$_2$, —S(=O)$_2$R$^5$, —C(O)R$^5$, —C(O)OR$^5$, —NR$^6$C(O)N(R$^6$)$_2$, —NR$^6$C(O)R$^5$, —NR$^6$C(O)OR$^5$, C$_{1-6}$alkyl, C$_{1-6}$heteroalkyl, C$_{2-9}$heterocycloalkyl, or C$_{2-9}$heteroaryl, wherein each alkyl, heteroalkyl, heterocycloalkyl, and heteroaryl is optionally substituted with one or more R$^7$, or R$^2$ and R$^3$ are taken together with the atoms to which they are attached to form an optionally substituted C$_{3-8}$cycloalkyl. In some embodiments, for a compound of Formula (III), R$^3$ is C$_{1-6}$alkyl substituted with C$_{2-9}$heterocycloalkyl. In some embodiments, for a compound of Formula (III), R$^3$ is CH$_2$—N-methylpiperazine. In some embodiments, for a compound of Formula (III), R$^2$ and R$^3$ are taken together with the atoms to which they are attached to form a C$_5$ cycloalkyl. In some embodiments, for a compound of Formula (III), R$^2$ and R$^3$ are taken together with the atoms to which they are attached to form a C$_5$ cycloalkyl substituted with an N-methylpiperazine.

Disclosed herein, are antagonists or partial antagonists of RIPK2 having a structure of Formula (III) or a pharmaceutically acceptable salt or isotopic variant thereof:

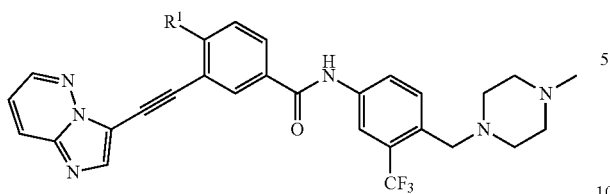

Formula (III)

wherein
R¹ is $C_{1-6}$alkyl.

In some embodiments a compound of Formula (III) or a pharmaceutically acceptable salt or isotopic variant thereof has the structure of:

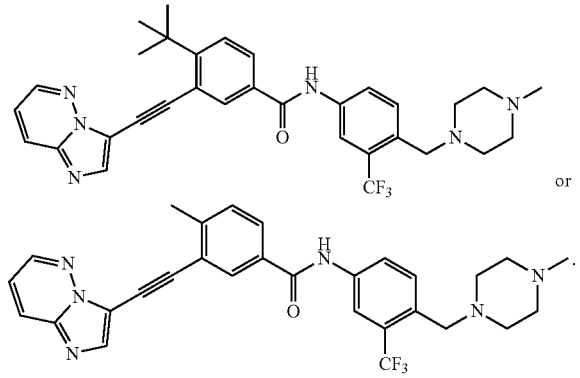

or

Disclosed herein, are antagonists or partial antagonists of RIPK2 having a structure of Formula (IV) or a pharmaceutically acceptable salt or isotopic variant thereof:

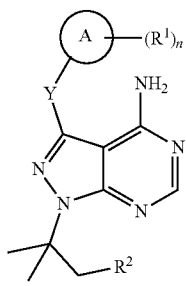

Formula (IV)

wherein
Ring A is $C_{3-8}$cycloalkyl, $C_{2-9}$heterocycloalkyl, $C_{2-9}$heteroaryl, or 6- to 10-membered aryl;
Y is a bond, —O—, —S—, —C(R⁵)₂—, —NR⁶—, —NR⁶C(O)—, —C(O)NR⁶—, or —NR⁶C(O)NR⁶—;
R¹ is —H, halogen, —OH, —CN, —N(R⁶)₂, —NR⁶C(O)R⁵, —C(O)OR⁵, —C(O)N(R⁶)₂, $C_{1-6}$alkyl, $C_{2-6}$alkenyl, $C_{2-6}$alkynyl, $C_{3-8}$cycloalkyl, —$C_{1-6}$alkyl-OH, —$C_{1-6}$alkyl-OR⁵, —$C_{1-6}$alkyl-N(R⁶)₂, —O—$C_{1-6}$alkyl, —O—$C_{1-6}$alkyl-OH, —O—$C_{1-6}$alkyl-OR⁵, —O—$C_{1-6}$alkyl-N(R⁶)₂, or —S(=O)₂R⁵;
R² is —H, halogen, —NO₂, —CN, —OH, —OR⁵, —SR⁵, —N(R⁶)₂, —S(O)R⁵, —S(=O)₂R⁵, —NR⁶S(=O)₂R⁵, —S(=O)₂N(R⁶)₂, —C(O)R⁵, —C(O)OR⁵, —OC(O)R⁵, —C(O)N(R⁶)₂, —OC(O)N(R⁶)₂, —NR⁶C(O)N(R⁶)₂, —NR⁶C(O)R⁵, —NR⁶C(O)OR⁵, $C_{1-6}$alkyl, $C_{2-6}$alkenyl, $C_{2-6}$alkynyl, $C_{1-6}$haloalkyl, $C_{1-6}$heteroalkyl, —O—$C_{1-6}$alkyl, $C_{3-8}$cycloalkyl, $C_{2-9}$heterocycloalkyl, $C_{2-9}$heteroaryl, 6- to 10-membered aryl, or —O-phenyl, wherein each alkyl, haloalkyl, heteroalkyl, cycloalkyl, heterocycloalkyl, aryl, and heteroaryl is optionally substituted with one or more R⁷;
R⁵ is —H, $C_{1-6}$alkyl, $C_{2-6}$alkenyl, $C_{2-6}$alkynyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, or —$C_{1-6}$alkyl-$C_{2-9}$heteroaryl;
each R⁶ is independently —H, $C_{1-6}$alkyl, $C_{2-6}$alkenyl, $C_{2-6}$alkynyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, or $C_{2-9}$heteroaryl; or
two R⁶ substituents are taken together with the nitrogen atom to which they are attached to form a 5- or 6-membered heterocycle;
R⁷ is —H, halogen, $C_{1-6}$alkyl, $C_{2-6}$alkenyl, $C_{2-6}$alkynyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, or —$C_{1-6}$alkyl-$C_{2-9}$heteroaryl; and
n is 0, 1, 2, 3, 4, or 5.

In some embodiments, for a compound of Formula (IV), Ring A is $C_{3-8}$cycloalkyl, $C_{2-9}$heterocycloalkyl, $C_{2-9}$heteroaryl, or 6- to 10-membered aryl. In some embodiments, for a compound of Formula (IV), Ring A is 6- to 10-membered aryl. In some embodiments, for a compound of Formula (IV), Ring A is phenyl. In some embodiments, for a compound of Formula (IV), Ring A is naphthyl.

In some embodiments, for a compound of Formula (IV), Y is a bond, —O—, —S—, —C(R⁵)₂—, —NR⁶—, —NR⁶C(O)—, —C(O)NR⁶—, or —NR⁶C(O)NR⁶—. In some embodiments, for a compound of Formula (IV), Y is a bond or —C(R⁵)₂—. In some embodiments, for a compound of Formula (IV), Y is a bond. In some embodiments, for a compound of Formula (IV), Y is —CH₂—.

In some embodiments, for a compound of Formula (IV), R¹ is —H, halogen, —OH, —CN, —N(R⁶)₂, —NR⁶C(O)R⁵, —C(O)OR⁵, —C(O)N(R⁶)₂, $C_{1-6}$alkyl, $C_{2-6}$alkenyl, $C_{2-6}$alkynyl, $C_{3-8}$cycloalkyl, —$C_{1-6}$alkyl-OH, —$C_{1-6}$alkyl-OR⁵, —$C_{1-6}$alkyl-N(R⁶)₂, —O—$C_{1-6}$alkyl-OH, —O—$C_{1-6}$alkyl-OR⁵, —O—$C_{1-6}$alkyl-N(R⁶)₂, or —S(=O)₂R⁵. In some embodiments, for a compound of Formula (IV), R¹ is —H, halogen, or $C_{1-6}$alkyl. In some embodiments, for a compound of Formula (IV), R¹ is —H, —Cl, or CH₃. In some embodiments, for a compound of Formula (IV), R¹ is —H. In some embodiments, for a compound of Formula (IV), R¹ is In some embodiments, for a compound of Formula (IV), R¹ is —CH₃.

In some embodiments, for a compound of Formula (IV), R² is —H, halogen, —NO₂, —CN, —OH, —OR⁵, —SR⁵, —N(R⁶)₂, —S(O)R⁵, —S(=O)₂R⁵, —NR⁶S(=O)₂R⁵, —S(=O)₂N(R⁶)₂, —C(O)R⁵, —C(O)OR⁵, —OC(O)R⁵, —C(O)N(R⁶)₂, —OC(O)N(R⁶)₂, —NR⁶C(O)N(R⁶)₂, —NR⁶C(O)R⁵, —NR⁶C(O)OR⁵, $C_{1-6}$alkyl, $C_{2-6}$alkenyl, $C_{2-6}$alkynyl, $C_{1-6}$haloalkyl, $C_{1-6}$heteroalkyl, —O—$C_{1-6}$alkyl, $C_{3-8}$cycloalkyl, $C_{2-9}$heterocycloalkyl, $C_{2-9}$heteroaryl, 6- to 10-membered aryl, or —O-phenyl, wherein each alkyl, haloalkyl, heteroalkyl, cycloalkyl, heterocycloalkyl, aryl, and heteroaryl is optionally substituted with one or more R⁷. In some embodiments, for a compound of Formula (IV), R² is —H or —NR⁶C(O)R⁵. In some embodiments, for a compound of Formula (IV), R² is —H or —NR⁶C(O)$C_{2-9}$heteroaryl. In some embodiments, for a compound of Formula (IV), R² is —H. In some embodiments, for a compound of Formula (IV), R² is —NHC(O)pyridyl.

In some embodiments, for a compound of Formula (IV), n is 1, 2, or 3. In some embodiments, for a compound of Formula (IV), n is 1 or 2. In some embodiments, for a compound of Formula (IV), n is 1. In some embodiments, for a compound of Formula (IV), n is 2. In some embodiments, for a compound of Formula (IV), n is 3.

Disclosed herein, are antagonists or partial antagonists of RIPK2 having a structure of Formula (IVa) or a pharmaceutically acceptable salt or isotopic variant thereof:

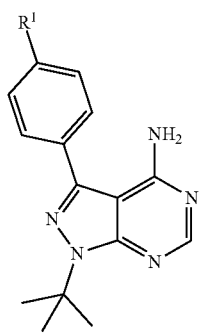

Formula (IVa)

wherein
R¹ is halogen or C₁₋₆alkyl.

Disclosed herein, are antagonists or partial antagonists of RIPK2 having a structure of Formula (IVb) or a pharmaceutically acceptable salt or isotopic variant thereof:

Formula (IVb)

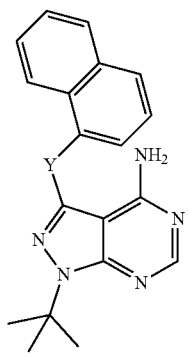

wherein Y is a bond or —C₁₋₃alkyl-.

Disclosed herein, are antagonists or partial antagonists of RIPK2 having a structure of Formula (IVb) or a pharmaceutically acceptable salt or isotopic variant thereof:

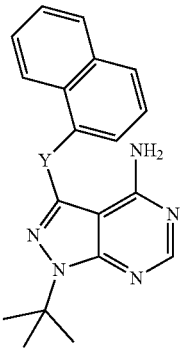

Formula (IVb)

wherein
Y is a bond or —CH₂—.

In some embodiments a compound of Formula (IV) or a pharmaceutically acceptable salt or isotopic variant thereof has the structure of:

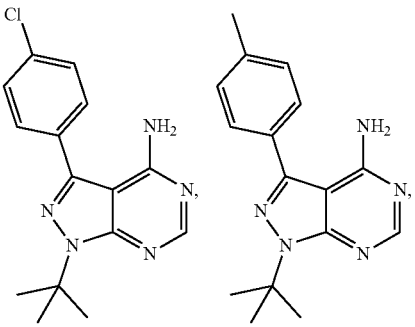

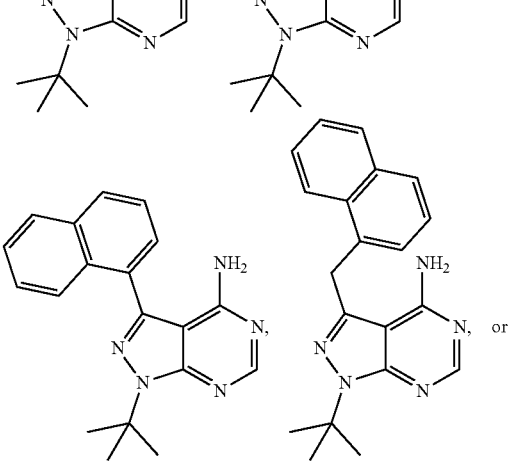

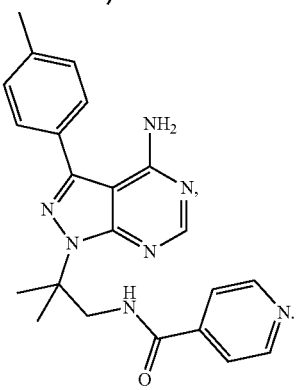

Disclosed herein, are antagonists or partial antagonists of RIPK2 having a structure of Formula (V) or a pharmaceutically acceptable salt or isotopic variant thereof:

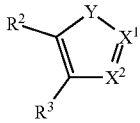

Formula (V)

wherein $X^1$ and $X^2$ are independently N or $CR^4$;

Y is S, O, or $NR^1$;

$R^1$ is —H, —S(=O)$_2R^5$, —S(=O)$_2$N($R^6$)$_2$, —C(O)$R^5$, —C(O)O$R^5$, —C(O)N($R^6$)$_2$, $C_{1-6}$alkyl, $C_{2-6}$alkenyl, $C_{2-6}$alkynyl, $C_{1-6}$haloalkyl, $C_{1-6}$heteroalkyl, $C_{3-8}$cycloalkyl, $C_{2-9}$heterocycloalkyl, $C_{2-9}$heteroaryl, or 6- to 10-membered aryl, wherein each alkyl, haloalkyl, heteroalkyl, cycloalkyl, heterocycloalkyl, aryl, and heteroaryl is optionally substituted with one or more $R^7$;

$R^2$ is —H, halogen, —NO$_2$, —CN, —OH, —O$R^5$, —S$R^5$, —N($R^6$)$_2$, —S(O)$R^5$, —S(=O)$_2R^5$, —$NR^6$S(=O)$_2R^5$, —S(=O)$_2$N($R^6$)$_2$, —C(O)$R^5$, —C(O)O$R^5$, —OC(O)$R^5$, —C(O)N($R^6$)$_2$, —OC(O)N($R^6$)$_2$, —$NR^6$C(O)N($R^6$)$_2$, —$NR^6$C(O)$R^5$, —$NR^6$C(O)O$R^5$, $C_{1-6}$alkyl, $C_{2-6}$alkenyl, $C_{2-6}$alkynyl, $C_{1-6}$haloalkyl, $C_{1-6}$heteroalkyl, —O—$C_{1-6}$alkyl, $C_{3-8}$cycloalkyl, $C_{2-9}$heterocycloalkyl, $C_{2-9}$heteroaryl, 6- to 10-membered aryl, or —O-phenyl, wherein each alkyl, haloalkyl, heteroalkyl, cycloalkyl, heterocycloalkyl, aryl, and heteroaryl is optionally substituted with one or more $R^7$; or $R^1$ and $R^2$ are taken together with the atoms to which they are attached to form an optionally substituted $C_{3-8}$heterocycloalkyl; and $R^3$ and $R^4$ are independently —H, halogen, —NO$_2$, —CN, —OH, —O$R^5$, —S$R^5$, —N($R^6$)$_2$, —S(O)$R^5$, —S(=O)$_2R^5$, —$NR^6$S(=O)$_2R^5$, —S(=O)$_2$N($R^6$)$_2$, —C(O)$R^5$, —C(O)O$R^5$, —OC(O)$R^5$, —C(O)N($R^6$)$_2$, —OC(O)N($R^6$)$_2$, —$NR^6$C(O)N($R^6$)$_2$, —$NR^6$C(O)$R^5$, —$NR^6$C(O)O$R^5$, $C_{1-6}$alkyl, $C_{2-6}$alkenyl, $C_{2-6}$alkynyl, $C_{1-6}$haloalkyl, $C_{1-6}$heteroalkyl, —O—$C_{1-6}$alkyl, $C_{3-8}$cycloalkyl, $C_{2-9}$heterocycloalkyl, $C_{2-9}$heteroaryl, 6- to 10-membered aryl, or —O-phenyl, wherein each alkyl, haloalkyl, heteroalkyl, cycloalkyl, heterocycloalkyl, aryl, and heteroaryl is optionally substituted with one or more $R^7$;

$R^5$ is —H, $C_{1-6}$alkyl, $C_{2-6}$alkenyl, $C_{2-6}$alkynyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, or —$C_{1-6}$alkyl-$C_{2-9}$heteroaryl;

each $R^6$ is independently —H, $C_{1-6}$alkyl, $C_{2-6}$alkenyl, $C_{2-6}$alkynyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, or $C_{2-9}$heteroaryl; or two $R^6$ substituents are taken together with the nitrogen atom to which they are attached to form a 5- or 6-membered heterocycle; and $R^7$ is —H, halogen, —S(=O)CH$_3$, —N($R^6$)$_2$, —C(O)N($R^6$)$_2$, $C_{1-6}$alkyl, $C_{2-6}$alkenyl, $C_{2-6}$alkynyl, $C_{1-6}$haloalkyl, $C_{1-6}$heteroalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, or —$C_{1-6}$alkyl-$C_{2-9}$heteroaryl.

In some embodiments, for a compound of Formula (V), $X^1$ and $X^2$ are independently N or $CR^4$. In some embodiments, for a compound of Formula (V), $X^1$ is N. In some embodiments, for a compound of Formula (V), $X^1$ is $CR^4$. In some embodiments, for a compound of Formula (V), $X^2$ is N. In some embodiments, for a compound of Formula (V), $X^2$ is $CR^4$. In some embodiments, for a compound of Formula (V), $X^1$ is N and $X^2$ is $CR^4$. In some embodiments, for a compound of Formula (V), $X^1$ is $CR^4$ and $X^2$ is N.

In some embodiments, for a compound of Formula (V), Y is S, O, or $NR^1$. In some embodiments, for a compound of Formula (V), Y is S. In some embodiments, for a compound of Formula (V), Y is NH. In some embodiments, for a compound of Formula (V), Y is NR'.

In some embodiments, for a compound of Formula (V), $R^1$ is —H, —S(=O)$_2R^5$, —S(=O)$_2$N($R^6$)$_2$, —C(O)$R^5$, —C(O)O$R^5$, —C(O)N($R^6$)$_2$, $C_{1-6}$alkyl, $C_{2-6}$alkenyl, $C_{2-6}$alkynyl, $C_{1-6}$haloalkyl, $C_{1-6}$heteroalkyl, $C_{3-8}$cycloalkyl, $C_{2-9}$heterocycloalkyl, $C_{2-9}$heteroaryl, or 6- to 10-membered aryl, wherein each alkyl, haloalkyl, heteroalkyl, cycloalkyl, heterocycloalkyl, aryl, and heteroaryl is optionally substituted with one or more $R^7$. In some embodiments, for a compound of Formula (V), $R^1$ is —H, $C_{1-6}$alkyl, $C_{3-8}$cycloalkyl, $C_{2-9}$heterocycloalkyl, $C_{2-9}$heteroaryl, or 6- to 10-membered aryl, wherein each cycloalkyl, heterocycloalkyl, aryl, and heteroaryl is optionally substituted with one or more $R^7$. In some embodiments, for a compound of Formula (V), $R^1$ is aryl optionally substituted with one or more $R^7$. In some embodiments, for a compound of Formula (V), $R^1$ is 2,4-dichlorophenyl.

In some embodiments, for a compound of Formula (V), $R^2$ is —H, halogen, —NO$_2$, —CN, —OH, —O$R^5$, —S$R^5$, —N($R^6$)$_2$, —S(O)$R^5$, —S(=O)$_2R^5$, —$NR^6$S(=O)$_2R^5$, —S(=O)$_2$N($R^6$)$_2$, —C(O)$R^5$, —C(O)O$R^5$, —OC(O)$R^5$, —C(O)N($R^6$)$_2$, —OC(O)N($R^6$)$_2$, —$NR^6$C(O)N($R^6$)$_2$, —$NR^6$C(O)$R^5$, —$NR^6$C(O)O$R^5$, $C_{1-6}$alkyl, $C_{2-6}$alkenyl, $C_{2-6}$alkynyl, $C_{1-6}$haloalkyl, $C_{1-6}$heteroalkyl, —O—$C_{1-6}$alkyl, $C_{3-8}$cycloalkyl, $C_{2-9}$heterocycloalkyl, $C_{2-9}$heteroaryl, 6- to 10-membered aryl, or —O-phenyl, wherein each alkyl, haloalkyl, heteroalkyl, cycloalkyl, heterocycloalkyl, aryl, and heteroaryl is optionally substituted with one or more $R^7$, or $R^1$ and $R^2$ are taken together with the atoms to which they are attached to form an optionally substituted $C_{3-8}$heterocycloalkyl. In some embodiments, for a compound of Formula (V), $R^2$ is —H, halogen, —S(=O)$_2R^5$, —$NR^6$S(=O)$_2R^5$, —S(=O)$_2$N($R^6$)$_2$, —C(O)$R^5$, —C(O)O$R^5$, —C(O)N($R^6$)$_2$, $C_{1-6}$alkyl, $C_{2-6}$alkenyl, $C_{2-6}$alkynyl, $C_{3-8}$cycloalkyl, $C_{2-9}$heterocycloalkyl, $C_{2-9}$heteroaryl, 6- to 10-membered aryl, or —O-phenyl, wherein each alkyl, cycloalkyl, heterocycloalkyl, aryl, and heteroaryl is optionally substituted with one or more $R^7$, or $R^1$ and $R^2$ are taken together with the atoms to which they are attached to form an optionally substituted $C_{3-8}$heterocycloalkyl. In some embodiments, for a compound of Formula (V), $R^2$ is —C(O)N($R^6$)$_2$ or 6-membered aryl optionally substituted with one or more $R^7$. In some embodiments, for a compound of Formula (V), $R^2$ is 4-fluorophenyl. In some embodiments, for a compound of Formula (V), $R^2$ is 4-chlorophenyl. In some embodiments, for a compound of Formula (V), $R^2$ is 2-methylpyridinyl. In some embodiments, for a compound of Formula (V), $R^2$ is —C(O)NH-(2-methyl-6-chlorophenyl). In some embodiments, for a compound of Formula (V), $R^1$ and $R^2$ are taken together with the atoms to which they are attached to form an optionally substituted $C_{3-8}$heterocycloalkyl. In some embodiments, for a compound of Formula (V), $R^1$ and $R^2$ are taken together with the atoms to which they are attached to form a $C_5$ heterocycloalkyl.

In some embodiments, for a compound of Formula (V), $R^3$ is —H, halogen, —NO$_2$, —CN, —OH, —O$R^5$, —S$R^5$, —N($R^6$)$_2$, —S(O)$R^5$, —S(=O)$_2R^5$, —$NR^6$S(=O)$_2R^5$, —S(=O)$_2$N($R^6$)$_2$, —C(O)$R^5$, —C(O)O$R^5$, —OC(O)$R^5$, —C(O)N($R^6$)$_2$, —OC(O)N($R^6$)$_2$, —$NR^6$C(O)N($R^6$)$_2$, —NR⁶C(O)R⁵, —NR⁶C(O)OR⁵, C₁₋₆alkyl, C₂₋₆alkenyl, C₂₋₆alkynyl, C₁₋₆haloalkyl, C₁₋₆heteroalkyl, —O—C₁₋₆alkyl, C₃₋₈cycloalkyl, C₂₋₉heterocycloalkyl, C₂₋₉heteroaryl, 6- to 10-membered aryl, or —O-phenyl, wherein each alkyl, haloalkyl, heteroalkyl, cycloalkyl, heterocycloalkyl, aryl, and heteroaryl is optionally substituted with one or more R⁷. In some embodiments, for a compound of Formula (V), R³ is —H, C₁₋₆alkyl, C₂₋₆alkenyl, C₂₋₆alkynyl, C₁₋₆haloalkyl, C₁₋₆heteroalkyl, C₃₋₈cycloalkyl, C₂₋₉heterocycloalkyl, C₂₋₉heteroaryl, 6- to 10-membered aryl, or —O-phenyl, wherein each alkyl, haloalkyl, heteroalkyl, cycloalkyl, heterocycloalkyl, aryl, and heteroaryl is optionally substituted with one or more R⁷. In some embodiments, for a compound of Formula (V), R³ is —H or C₂₋₉heteroaryl optionally substituted with one or more R⁷. In some embodiments, for a compound of Formula (V), R³ is H. In some embodiments, for a compound of Formula (V), R³ is C₂₋₉heteroaryl optionally substituted with one or more R⁷. In some embodiments, for a compound of Formula (V), R³ is optionally substituted pyridinyl. In some embodiments, for a compound of Formula (V), R³ is optionally substituted quinolinyl. In some embodiments, for a compound of Formula (V), R³ is optionally substituted [1,2,4]triazolopyridinyl.

In some embodiments, for a compound of Formula (V), R⁴ is —H, halogen, —NO₂, —CN, —OH, —OR⁵, —SR⁵, —N(R⁶)₂, —S(O)R⁵, —S(=O)₂R⁵, —NR⁶S(=O)₂R⁵, —S(=O)₂N(R⁶)₂, —C(O)R⁵, —C(O)OR⁵, —OC(O)R⁵, —C(O)N(R⁶)₂, —OC(O)N(R⁶)₂, —NR⁶C(O)N(R⁶)₂, —NR⁶C(O)R⁵, —NR⁶C(O)OR⁵, C₁₋₆alkyl, C₂₋₆alkenyl, C₂₋₆alkynyl, C₁₋₆haloalkyl, C₁₋₆heteroalkyl, —O—C₁₋₆alkyl, C₃₋₈ cycloalkyl, C₂₋₉heterocycloalkyl, C₂₋₉heteroaryl, 6- to 10-membered aryl, or —O-phenyl, wherein each alkyl, haloalkyl, heteroalkyl, cycloalkyl, heterocycloalkyl, aryl, and heteroaryl is optionally substituted with one or more R⁷. In some embodiments, for a compound of Formula (V), R⁴ is —H, —N(R⁶)₂, —C(O)R⁵, —C(O)OR⁵, —OC(O)R⁵, —C(O)N(R⁶)₂, —OC(O)N(R⁶)₂, C₁₋₆alkyl, C₂₋₆alkenyl, C₂₋₆alkynyl, C₁₋₆haloalkyl, C₁₋₆heteroalkyl, C₃₋₈cycloalkyl, C₂₋₉heterocycloalkyl, C₂₋₉heteroaryl, 6- to 10-membered aryl, or —O-phenyl, wherein each alkyl, haloalkyl, heteroalkyl, cycloalkyl, heterocycloalkyl, aryl, and heteroaryl is optionally substituted with one or more R⁷. In some embodiments, for a compound of Formula (V), R⁴ is —N(R⁶)₂, C₁₋₆alkyl, C₂₋₉heteroaryl, or 6- to 10-membered aryl, wherein each aryl and heteroaryl is optionally substituted with one or more R⁷. In some embodiments, for a compound of Formula (V), R⁴ is optionally substituted phenyl. In some embodiments, for a compound of Formula (V), R⁴ is optionally substituted pyridyl. In some embodiments, for a compound of Formula (V), R⁴ is —NHpyrimidine. In some embodiments, for a compound of Formula (V), R⁴ is —CH₂phenyl. In some embodiments, for a compound of Formula (V), R⁴ is CH₂NHphenyl.

In some embodiments a compound of Formula (V) or a pharmaceutically acceptable salt or isotopic variant thereof has the structure of:

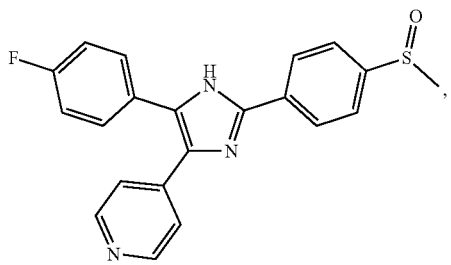

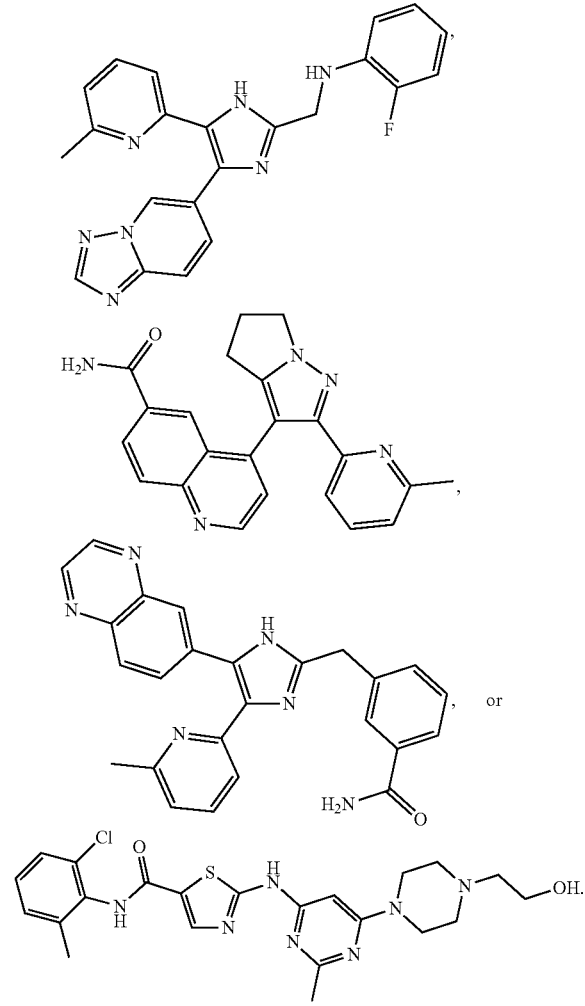

Disclosed herein, are antagonists or partial antagonists of RIPK2 having a structure of Formula (VI) or a pharmaceutically acceptable salt or isotopic variant thereof:

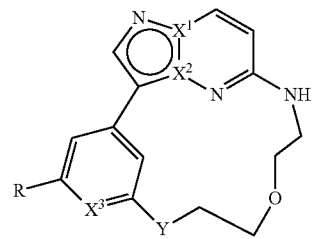

Formula (VI)

wherein
X¹ and X² are independently N or C;
X³ is N or CR⁴;
Y is a bond, —O—, —S—, —C(R⁵)₂, —NR⁶—, —NR⁶C(O)—, —C(O)NR⁶—, or —NR⁶C(O)NR⁶—;
R is —H, halogen, —NO₂, —CN, —OH, —OR⁵, —SR⁵, —N(R⁶)₂, —S(O)R⁵, —S(=O)₂R⁵, —NR⁶S(=O)₂R⁵, —S(=O)₂N(R⁶)₂, —C(O)R⁵, —C(O)OR⁵, —OC(O)R⁵, —C(O)N(R⁶)₂, —OC(O)N(R⁶)₂, —NR⁶C(O)N(R⁶)₂, —NR⁶C(O)R⁵, —NR⁶C(O)OR⁵, C₁₋₆alkyl, $C_{2-6}$alkenyl, $C_{2-6}$alkynyl, $C_{1-6}$haloalkyl, $C_{1-6}$heteroalkyl, —O—$C_{1-6}$alkyl, $C_{3-8}$cycloalkyl, $C_{2-9}$heterocycloalkyl, $C_{2-9}$heteroaryl, 6- to 10-membered aryl, or —O-phenyl, wherein each alkyl, haloalkyl, heteroalkyl, cycloalkyl, heterocycloalkyl, aryl, and heteroaryl is optionally substituted with one or more $R^7$;

$R^4$ is —H, halogen, $C_{1-6}$alkyl, $C_{2-6}$alkenyl, $C_{2-6}$alkynyl, $C_{1-6}$haloalkyl, $C_{3-8}$cycloalkyl, $C_{2-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, or —$C_{1-6}$alkyl-$C_{2-9}$heteroaryl, wherein the alkyl, haloalkyl, cycloalkyl, phenyl, heteroaryl, and heterocycloalkyl are optionally substituted;

$R^5$ is —H, $C_{1-6}$alkyl, $C_{2-6}$alkenyl, $C_{2-6}$alkynyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$ heterocycloalkyl, $C_{2-9}$heteroaryl, or —$C_{1-6}$alkyl-$C_{2-9}$heteroaryl;

each $R^6$ is independently —H, $C_{1-6}$alkyl, $C_{2-6}$alkenyl, $C_{2-6}$alkynyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, or $C_{2-9}$heteroaryl; or two $R^6$ are taken together with the nitrogen atom to which they are attached to form a 5- or 6-membered heterocycle; and $R^7$ is —H, halogen, —S(=O)CH$_3$, —N($R^6$)$_2$, —C(O)N($R^6$)$_2$, $C_{1-6}$alkyl, $C_{2-6}$alkenyl, $C_{2-6}$alkynyl, $C_{1-6}$haloalkyl, $C_{1-6}$heteroalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, or —$C_{1-6}$alkyl-$C_{2-9}$heteroaryl.

In some embodiments, for a compound of Formula (VII), $X^1$ and $X^2$ are independently N or C. In some embodiments, for a compound of Formula (VII), $X^1$ is N. In some embodiments, for a compound of Formula (VII), $X^1$ is C. In some embodiments, for a compound of Formula (VII), $X^2$ is N. In some embodiments, for a compound of Formula (VII), $X^2$ is C. In some embodiments, for a compound of Formula (VII), $X^1$ is N and $X^2$ is C. In some embodiments, for a compound of Formula (VII), $X^1$ is C and $X^2$ is N.

In some embodiments, for a compound of Formula (VII), $X^3$ is N or CR$^4$. In some embodiments, for a compound of Formula (VII), $X^3$ is N or CH. In some embodiments, for a compound of Formula (VII), $X^3$ is N. In some embodiments, for a compound of Formula (VII), $X^3$ is CH.

In some embodiments, for a compound of Formula (VI), Y is a bond, —O—, —S—, —C($R^5$)$_2$, —NR$^6$—, —NR$^6$C(O)—, —C(O)NR$^6$—, or —NR$^6$C(O)NR$^6$—. In some embodiments, for a compound of Formula (VI), Y is —O— or —NR$^6$—. In some embodiments, for a compound of Formula (VI), Y is —O— or —NH—. In some embodiments, for a compound of Formula (VI), Y is —O—. In some embodiments, for a compound of Formula (VI), Y is —NH—.

In some embodiments, for a compound of Formula (VI), R is —H, halogen, —NO$_2$, —CN, —OH, —OR$^5$, —SR$^5$, —N($R^6$)$_2$, —S(O)R$^5$, —S(=O)$_2$R$^5$, —NR$^6$S(=O)$_2$R$^5$, —S(=O)$_2$N($R^6$)$_2$, —C(O)R$^5$, —C(O)OR$^5$, —OC(O)R$^5$, —C(O)N($R^6$)$_2$, —OC(O)N($R^6$)$_2$, —NR$^6$C(O)N($R^6$)$_2$, —NR$^6$C(O)R$^5$, —NR$^6$C(O)OR$^5$, $C_{1-6}$alkyl, $C_{2-6}$alkenyl, $C_{2-6}$alkynyl, $C_{1-6}$haloalkyl, $C_{1-6}$heteroalkyl, —O—$C_{1-6}$alkyl, $C_{3-8}$cycloalkyl, $C_{2-9}$heterocycloalkyl, $C_{2-9}$heteroaryl, 6- to 10-membered aryl, or —O-phenyl, wherein each alkyl, haloalkyl, heteroalkyl, cycloalkyl, heterocycloalkyl, aryl, and heteroaryl is optionally substituted with one or more $R^7$. In some embodiments, for a compound of Formula (VI), R is —H, halogen, —S(=O)$_2$R$^5$, —NR$^6$S(=O)$_2$R$^5$, —S(=O)$_2$N($R^6$)$_2$, —C(O)R$^5$, —C(O)OR$^5$, —OC(O)R$^5$, —C(O)N($R^6$)$_2$, —OC(O)N($R^6$)$_2$, $C_{1-6}$alkyl, $C_{2-6}$alkenyl, $C_{1-6}$heteroalkyl, $C_{3-8}$cycloalkyl, $C_{2-9}$heterocycloalkyl, $C_{2-9}$heteroaryl, 6- to 10-membered aryl, or —O-phenyl, wherein each alkyl, heteroalkyl, cycloalkyl, heterocycloalkyl, aryl, and heteroaryl is optionally substituted with one or more $R^7$. In some embodiments, for a compound of Formula (VI), R is —H or halogen. In some embodiments, for a compound of Formula (VI), R is —H. In some embodiments, for a compound of Formula (VI), R is —Cl.

In some embodiments a compound of Formula (VI) or a pharmaceutically acceptable salt or isotopic variant thereof has the structure of:

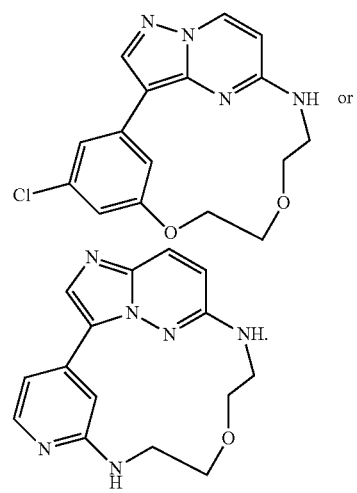

Disclosed herein, are antagonists or partial antagonists of RIPK2 having a structure of Formula (VII) or a pharmaceutically acceptable salt or isotopic variant thereof:

Formula (VII)

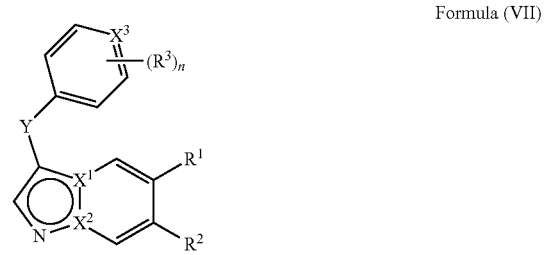

wherein $X^1$ and $X^2$ are independently N or C;

$X^3$ is N or CR$^4$;

Y is a bond, —O—, —S—, —C($R^5$)$_2$, —NR$^6$—, —NR$^6$C(O)—, —C(O)NR$^6$—, or —NR$^6$C(O)NR$^6$—;

$R^1$ and $R^2$ are independently —H, halogen, —OH, —CN, —N($R^6$)$_2$, —NR$^6$C(O)R$^5$, —C(O)OR$^5$, —C(O)N($R^6$)$_2$, $C_{1-6}$alkyl, $C_{2-6}$alkenyl, $C_{2-6}$alkynyl, $C_{3-8}$cycloalkyl, —$C_{1-6}$alkyl-OH, —$C_{1-6}$ alkyl-OR$^5$, —$C_{1-6}$alkyl-N($R^6$)$_2$, —O—$C_{1-6}$alkyl, —O—$C_{1-6}$alkyl-OH, —O—$C_{1-6}$alkyl-OR$^5$, —O—$C_{1-6}$alkyl-N($R^6$)$_2$, or —S(=O)$_2$R$^5$;

$R^3$ is —H, halogen, —NO$_2$, —CN, —OH, —OR$^5$, —SR$^5$, —N($R^6$)$_2$, —S(O)R$^5$, —S(=O)$_2$R$^5$, —NR$^6$S(=O)$_2$R$^5$, —S(=O)$_2$N($R^6$)$_2$, —C(O)R$^5$, —C(O)OR$^5$, —OC(O)R$^5$, —C(O)N($R^6$)$_2$, —OC(O)N($R^6$)$_2$, —NR$^6$C(O)N($R^6$)$_2$, —NR$^6$C(O)R$^5$, —NR$^6$C(O)OR$^5$, $C_{1-6}$alkyl, $C_{2-6}$alkenyl, $C_{2-6}$alkynyl, $C_{1-6}$haloalkyl, $C_{1-6}$heteroalkyl, —O—$C_{1-6}$alkyl, $C_{3-8}$cycloalkyl, $C_{2-9}$heterocycloalkyl, $C_{2-9}$heteroaryl, 6- to 10-membered aryl, or —O-phenyl, wherein each alkyl, haloalkyl, heteroalkyl, cycloalkyl, heterocycloalkyl, aryl, and heteroaryl is optionally substituted with one or more $R^7$;

$R^4$ is —H, halogen, $C_{1-6}$alkyl, $C_{2-6}$alkenyl, $C_{2-6}$alkynyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, or —$C_{1-6}$alkyl-$C_{2-9}$heteroaryl, wherein the alkyl, haloalkyl, cycloalkyl, phenyl, heteroaryl, and heterocycloalkyl are optionally substituted;

$R^5$ is —H, $C_{1-6}$alkyl, $C_{2-6}$alkenyl, $C_{2-6}$alkynyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, or —$C_{1-6}$alkyl-$C_{2-9}$heteroaryl;

each $R^6$ is independently —H, $C_{1-6}$alkyl, $C_{2-6}$alkenyl, $C_{2-6}$alkynyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, or $C_{2-9}$heteroaryl; or two $R^6$ substituents are taken together with the nitrogen atom to which they are attached to form a 5- or 6-membered heterocycle;

$R^7$ is —H, halogen, —S(=O)CH$_3$, —N(R$^6$)$_2$, —C(O)N(R$^6$)$_2$, $C_{1-6}$alkyl, $C_{2-6}$alkenyl, $C_{2-6}$alkynyl, $C_{1-6}$haloalkyl, $C_{1-6}$heteroalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, or —$C_{1-6}$alkyl-$C_{2-9}$heteroaryl; and n is 0, 1, 2, 3, 4, or 5.

In some embodiments, for a compound of Formula (VII), $X^1$ and $X^2$ are independently N or C. In some embodiments, for a compound of Formula (VII), $X^1$ is N. In some embodiments, for a compound of Formula (VII), $X^1$ is C. In some embodiments, for a compound of Formula (VII), $X^2$ is N. In some embodiments, for a compound of Formula (VII), $X^2$ is C. In some embodiments, for a compound of Formula (VII), $X^1$ is N and $X^2$ is C. In some embodiments, for a compound of Formula (VII), $X^1$ is C and $X^2$ is N.

In some embodiments, for a compound of Formula (VII), $X^3$ is N or CR$^4$. In some embodiments, for a compound of Formula (VII), $X^3$ is N or CH. In some embodiments, for a compound of Formula (VII), $X^3$ is N. In some embodiments, for a compound of Formula (VII), $X^3$ is CH.

In some embodiments, for a compound of Formula (VII), Y is a bond, —O—, —S—, —C(R$^5$)$_2$, —NR$^6$—, —NR$^6$C(O)—, —C(O)NR$^6$—, or —NR$^6$C(O)NR$^6$—. In some embodiments, for a compound of Formula (VII), Y is a bond, —NR$^6$C(O)—, or —C(O)NR$^6$—. In some embodiments, for a compound of Formula (VII), Y is a bond, —NHC(O)—, or —C(O)NH—. In some embodiments, for a compound of Formula (VII), Y is a bond. In some embodiments, for a compound of Formula (VII), Y is —NHC(O)—. In some embodiments, for a compound of Formula (VII), Y is —C(O)NH—.

In some embodiments, for a compound of Formula (VII), $R^1$ is —H, halogen, —OH, —CN, —N(R$^6$)$_2$, —NR$^6$C(O)R$^5$, —C(O)OR$^5$, —C(O)N(R$^6$)$_2$, $C_{1-6}$alkyl, $C_{2-6}$alkenyl, $C_{2-6}$alkynyl, $C_{3-8}$cycloalkyl, —$C_{1-6}$alkyl-OH, —$C_{1-6}$alkyl-OR$^5$, —$C_{1-6}$alkyl-N(R$^6$)$_2$, —O—$C_{1-6}$alkyl, —O—$C_{1-6}$alkyl-OH, —O—$C_{1-6}$alkyl-OR$^5$, —O—$C_{1-6}$alkyl-N(R$^6$)$_2$, or —S(=O)$_2$R$^5$. In some embodiments, for a compound of Formula (VII), $R^1$ is —H, halogen, —N(R$^6$)$_2$, —NR$^6$C(O)R$^5$, $C_{1-6}$alkyl, $C_{3-8}$cycloalkyl, —$C_{1-6}$alkyl-OH, —$C_{1-6}$alkyl-OR$^5$, —$C_{1-6}$alkyl-N(R$^6$)$_2$, —O—$C_{1-6}$alkyl-N(R$^6$)$_2$, or —S(=O)$_2$R$^5$. In some embodiments, for a compound of Formula (VII), $R^1$ is —H or —S(=O)$_2$R$^5$. In some embodiments, for a compound of Formula (VII), $R^1$ is —H. In some embodiments, for a compound of Formula (VII), $R^1$ is —S(=O)$_2$iso-propyl. In some embodiments, for a compound of Formula (VII), $R^1$ is —S(=O)$_2$tert-butyl.

In some embodiments, for a compound of Formula (VII), $R^2$ is —H, halogen, —OH, —CN, —N(R$^6$)$_2$, —NR$^6$C(O)R$^5$, —C(O)OR$^5$, —C(O)N(R$^6$)$_2$, $C_{1-6}$alkyl, $C_{2-6}$alkenyl, $C_{2-6}$alkynyl, $C_{3-8}$cycloalkyl, —$C_{1-6}$alkyl-OH, —$C_{1-6}$alkyl-OR$^5$, —$C_{1-6}$alkyl-N(R$^6$)$_2$, —O—$C_{1-6}$alkyl, —O—$C_{1-6}$alkyl-OH, —O—$C_{1-6}$alkyl-OR$^5$, —O—$C_{1-6}$alkyl-N(R$^6$)$_2$, or —S(=O)$_2$R$^5$. In some embodiments, for a compound of Formula (VII), $R^2$ is —H, $C_{1-6}$alkyl, $C_{2-6}$alkenyl, $C_{2-6}$alkynyl, $C_{3-8}$cycloalkyl, —O—$C_{1-6}$alkyl, —O—$C_{1-6}$alkyl-OH, or —O—$C_{1-6}$alkyl-OR$^5$. In some embodiments, for a compound of Formula (VII), $R^2$ is —H or —O—$C_{1-6}$alkyl. In some embodiments, for a compound of Formula (VII), $R^2$ is —H. In some embodiments, for a compound of Formula (VII), $R^2$ is —OCH$_3$. In some embodiments, for a compound of Formula (VII), $R^2$ is —OCH$_2$CH$_3$.

In some embodiments, for a compound of Formula (VII), $R^3$ is —H, halogen, —NO$_2$, —CN, —OH, —OR$^5$, —SR$^5$, —N(R$^6$)$_2$, —S(O)R$^5$, —S(=O)$_2$R$^5$, —NR$^6$S(=O)$_2$R$^5$, —S(=O)$_2$N(R$^6$)$_2$, —C(O)R$^5$, —C(O)OR$^5$, —OC(O)R$^5$, —C(O)N(R$^6$)$_2$, —OC(O)N(R$^6$)$_2$, —NR$^6$C(O)N(R$^6$)$_2$, —NR$^6$C(O)R$^5$, —NR$^6$C(O)OR$^5$, $C_{1-6}$alkyl, $C_{2-6}$alkenyl, $C_{2-6}$alkynyl, $C_{1-6}$haloalkyl, $C_{1-6}$heteroalkyl, —O—$C_{1-6}$alkyl, $C_{3-8}$cycloalkyl, $C_{2-9}$heterocycloalkyl, $C_{2-9}$heteroaryl, 6- to 10-membered aryl, or —O-phenyl, wherein each alkyl, haloalkyl, heteroalkyl, cycloalkyl, heterocycloalkyl, aryl, and heteroaryl is optionally substituted with one or more $R^7$. In some embodiments, for a compound of Formula (VII), $R^3$ is —H, halogen, —N(R$^6$)$_2$, —S(=O)$_2$R$^5$, —NR$^6$S(=O)$_2$R$^5$, —S(=O)$_2$N(R$^6$)$_2$, —NR$^6$C(O)N(R$^6$)$_2$, —NR$^6$C(O)R$^5$, —NR$^6$C(O)OR$^5$, $C_{1-6}$alkyl, $C_{1-6}$heteroalkyl, —O—$C_{1-6}$alkyl, $C_{3-8}$cycloalkyl, $C_{2-9}$heterocycloalkyl, $C_{2-9}$heteroaryl, or 6- to 10-membered aryl, wherein each alkyl, heteroalkyl, cycloalkyl, heterocycloalkyl, aryl, and heteroaryl is optionally substituted with one or more $R^7$. In some embodiments, for a compound of Formula (VII), $R^3$ is —H, halogen, —N(R$^6$)$_2$, or $C_{1-6}$alkyl. In some embodiments, for a compound of Formula (VII), $R^3$ is —H. In some embodiments, for a compound of Formula (VII), $R^3$ is —Cl. In some embodiments, for a compound of Formula (VII), $R^3$ is —F. In some embodiments, for a compound of Formula (VII), $R^3$ is —CH$_3$.

In some embodiments a compound of Formula (VII) or a pharmaceutically acceptable salt or isotopic variant thereof has the structure of:

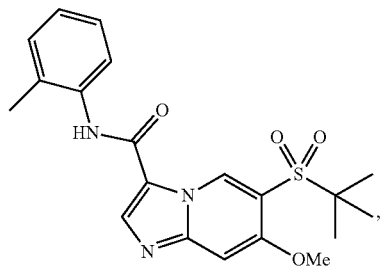

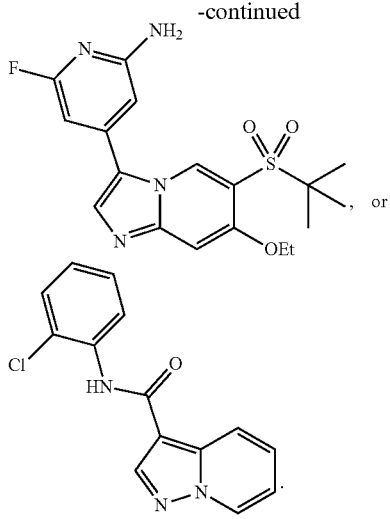

Disclosed herein, are antagonists or partial antagonists of RIPK2 having a structure of Formula (VIII) or a pharmaceutically acceptable salt or isotopic variant thereof:

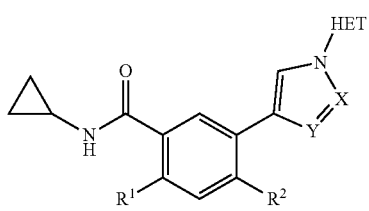

Formula (VIII)

wherein:
HET is

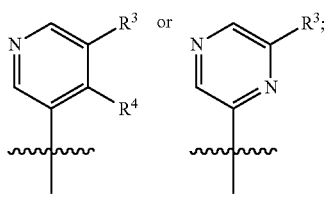

X is N and Y is CH; or
X is CH and Y is N;
$R^1$ is —H, or —F;
$R^2$ is $C_{1-3}$alkyl, —Cl, or —F;
$R^3$ and $R^4$ are each independently —H; —OR$^5$; —O—C$_{1-6}$alkyl-O—C$_{1-3}$alkyl; —O—C$_{3-6}$cycloalkyl; —C(O)R$^5$, C$_{1-6}$alkyl optionally substituted with one to three —OH, —F, C$_{3-8}$ heterocycloalkyl optionally substituted with oxo, C$_{3-6}$cycloalkyl, —C(O)OR$^5$, —O—C$_{1-6}$ alkyl, aryl, —N(R$^5$)(R$^6$), —CN, or —C(O)N(R$^5$)(R$^6$); C$_{3-6}$cycloalkyl optionally substituted with one to three —OH, one to three —F, C$_{1-6}$alkyl, —O—C$_{1-6}$alkyl, C$_{1-6}$alkyl-OC$_{1-6}$alkyl, C$_{1-6}$alkyl-OH, —CF$_3$, —CN, —OC$_{3-6}$cycloalkyl, —C(O)OH, —C(O)OR$^5$, C$_{3-6}$cycloalkyl, 5-6 membered heteroaryl, N(R$^5$)(R$^6$), or —C(O)N(R$^5$)(R$^6$); —C(O)OR$^5$; —C(O)N(R$^5$)(R$^6$); —S(=O)$_2$N(R$^5$)(R$^6$); —S(O)$_n$—R$^5$; a 4-10 membered monocyclic, bicyclic, or spirocyclic heterocyclyl group containing nitrogen, sulfur, or oxygen and optionally substituted with one to three —N(R$^5$)(R$^6$), halogen, —C$_{1-6}$alkyl, —O—C$_{1-6}$ alkyl, or —C$_{1-6}$haloalkyl; aryl; —N(R$^5$)(R$^6$); or halogen;

$R^5$ and $R^6$ are each independently —H; —C$_{1-6}$alkyl-C$_{3-8}$ heterocycloalkyl; a 4-6 membered heterocycloalkyl wherein the heterocycloalkyl ring is optionally substituted with one to three C$_{1-6}$alkyl, —C$_{1-6}$haloalkyl, C$_{1-6}$cycloalkyl, halogen, acyl, heterocycloalkyl, heterocycloalkyl-C$_{1-6}$alkyl, heterocycloalkyl-O—C$_{1-6}$alkyl, heterocycloalkyl-OH, heterocycloalkyl-C(O)CH$_3$, heterocycloalkyl-C(O)OC$_{1-3}$alkyl, —C$_{1-6}$alkyl-heterocycloalkyl, —C$_{1-6}$alkyl-heterocycloalkyl-C$_{1-6}$alkyl, —C$_{1-6}$alkyl-OH, —C$_{1-6}$ alkyl-O—C$_{1-6}$alkyl, C$_{3-6}$cycloalkyl, —C$_{1-6}$alkyl-cycloalkyl, C$_{3-6}$cycloalkyl-C$_{1-6}$alkyl, C$_{3-6}$cycloalkyl-O—C$_{1-6}$alkyl, or C$_{3-6}$cycloalkyl-O—C$_{1-6}$alkyl-OH; acyl; C$_{3-6}$cycloalkyl-C(O)—C$_{1-3}$alkyl; —C(O)—C$_{1-3}$alkyl-O—CH$_3$; —C(O)—C$_{1-3}$alkyl; —C(O)—C$_{3-6}$cycloalkyl; —C(O)—NH—C$_{1-3}$alkyl; —C(O)—NH—C$_{1-3}$alkyl; —C(O)—NH—C$_{3-6}$cycloalkyl optionally monosubstituted or disubstituted with —C$_{1-3}$alkyl-OH, —C(O)—NH—C$_{3-6}$heterocyclyl, —C(O)-aryl, —C(O)-heteroaryl, or —S(O)$_n$—C$_{1-3}$ alkyl; and C$_{1-6}$alkyl optionally substituted with —OH, O—C$_{1-3}$alkyl, C$_{3-6}$cycloalkyl, heterocyclyl, aryl, —NH—C$_{1-3}$alkyl, or —N—(C$_{1-3}$alkyl)$_2$; or
$R^5$ and $R^6$ together with the nitrogen atom to which they are attached form a 5-6 membered heterocyclic ring optionally substituted with methyl; and
n is 0, 1, or 2.

In some embodiments, for a compound of Formula (VIII), HET is

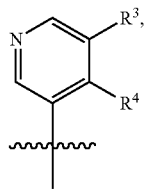

X is N, Y is CH, and n is 1 or 2. In some embodiments, for a compound of Formula (VIII), HET is

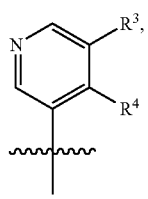

X is N, Y is CH, $R^2$ is —CH$_3$ or —Cl, $R^4$ is H, and n is 2. In some embodiments, for a compound of Formula (VIII), HET is

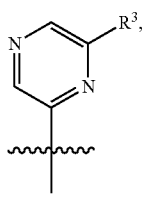

X is N, Y is CH, R² is —CH₃ or —Cl, and n is 2. In some embodiments, for a compound of Formula (VIII), HET is

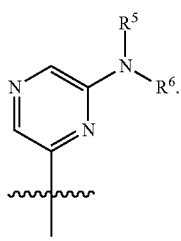

In some embodiments, for a compound of Formula (VIII), HET is

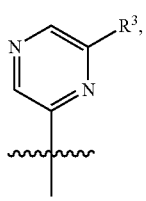

X is CH, Y is N, R² is —CH₃ or —Cl, and n is 2. In some embodiments, for a compound of Formula (VIII), HET is

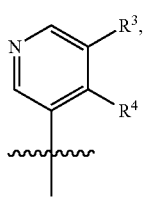

X is CH, Y is N, R² is —CH₃ or —Cl, R⁴ is —H, and n is 2. In some embodiments, for a compound of Formula (VIII), HET is

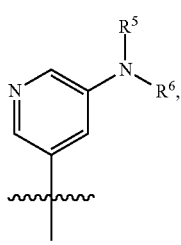

X is CH, Y is N, R² is —CH₃ or —Cl, R⁴ is —H, and n is 2.

In some embodiments, for a compound of Formula (VIII), HET is

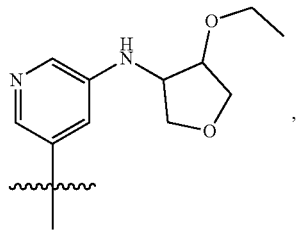

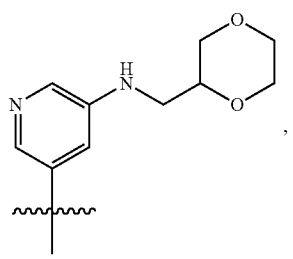

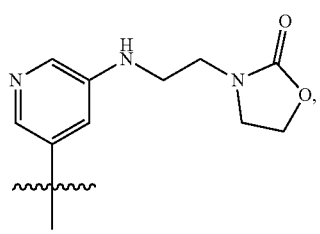

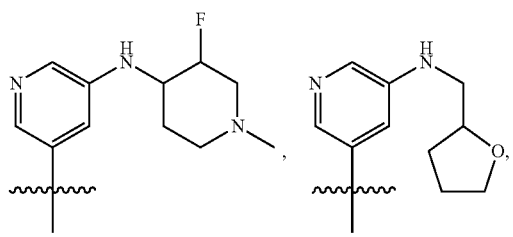

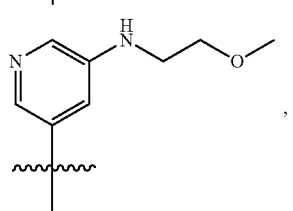

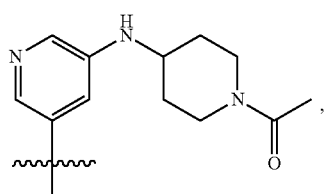

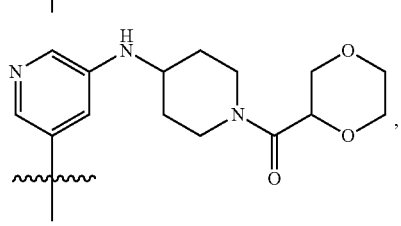

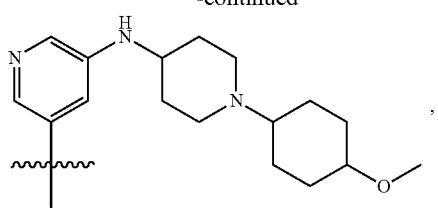
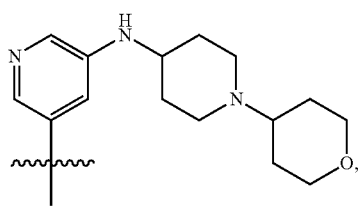
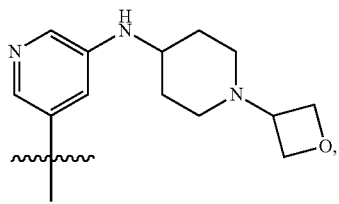
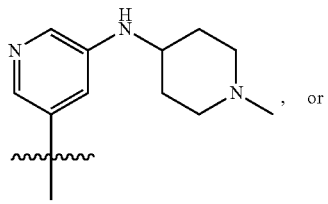, or
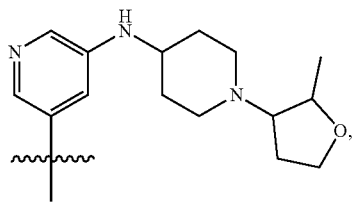
X is N, Y is CH, R¹ is —F, and R² is —CH₃. In some embodiments, for a compound of Formula (VIII), HET is
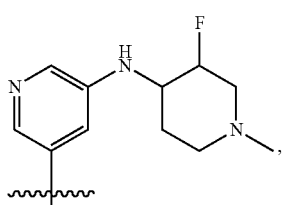
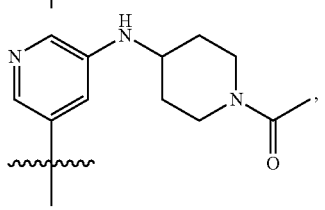
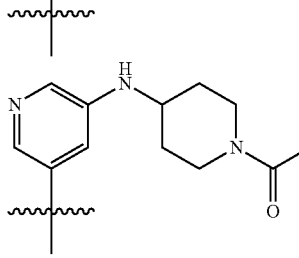
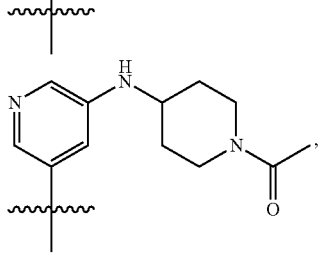
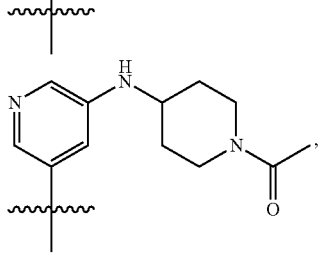
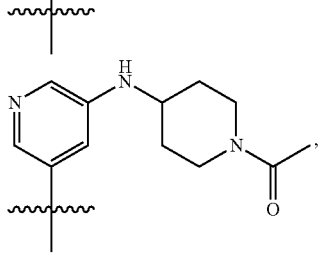
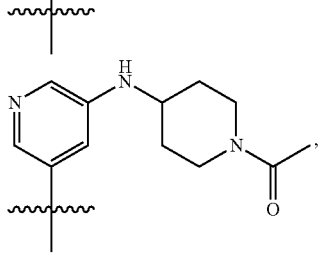, or
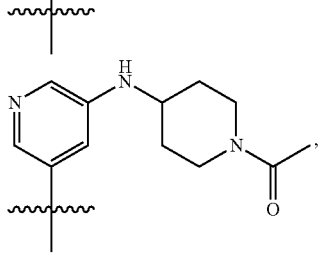
X is N, Y is CH, R¹ is —F, and R² is —CH₃. In some embodiments, for a compound of Formula (VIII), HET is
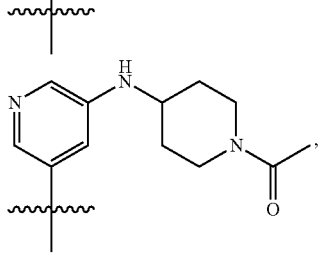

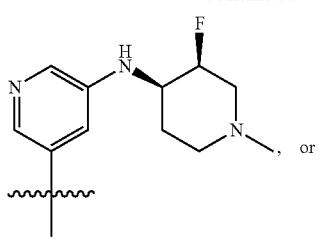

, or

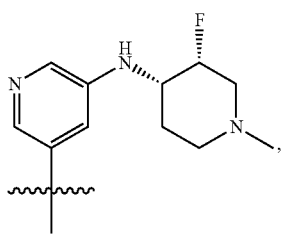

,

X is N, Y is CH, R¹ is —F, and R² is —CH₃.

In some embodiments, for a compound of Formula (VIII), HET is

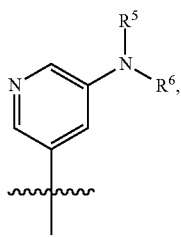

,

X is N, Y is CH, R² is —CH₃ or —Cl, R⁴ is H, and n is 2. In some embodiments, for a compound of Formula (VIII), HET is

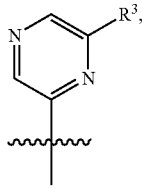

,

X is N, and Y is CH. In some embodiments, for a compound of Formula (VIII), HET is

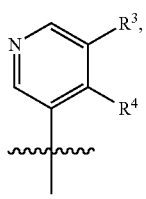

,

X is CH, and Y is N. In some embodiments, for a compound of Formula (VIII), HET is

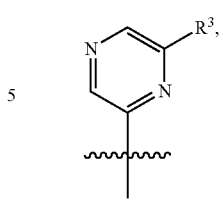

,

X is CH, and Y is N.

In some embodiments, for a compound of Formula (VIII), HET is

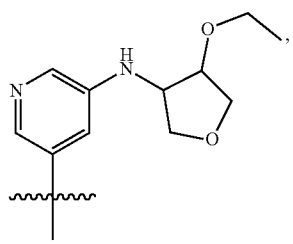

,

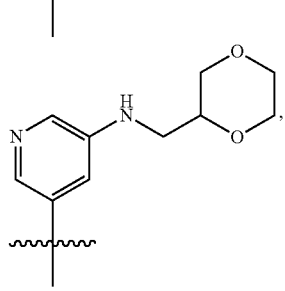

,

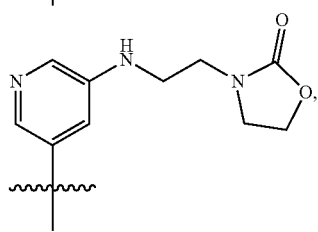

,

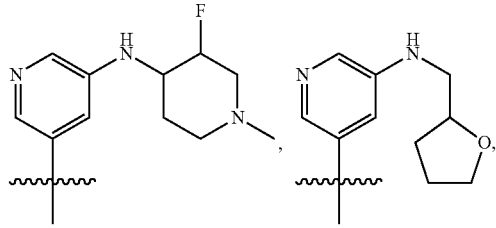

,

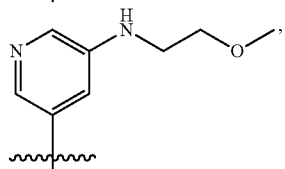

,

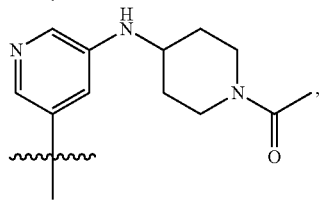

,

189
-continued
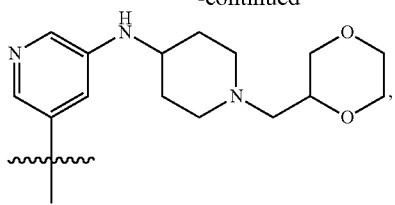
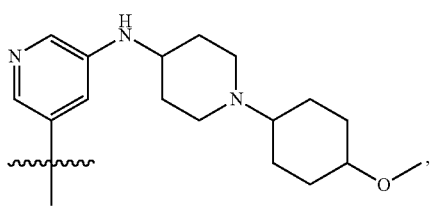
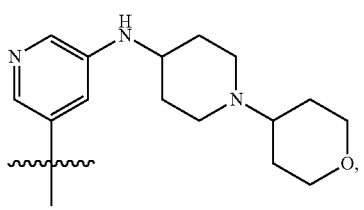
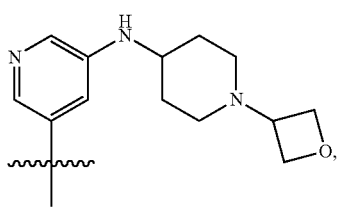
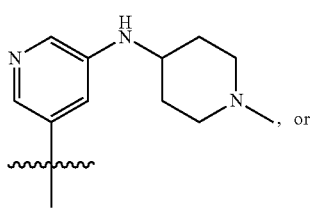, or
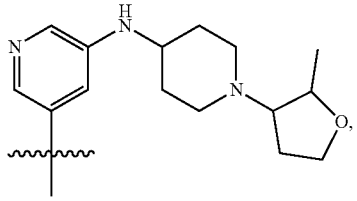
X is N, Y is CH, R² is —CH₃ or —Cl, R⁴ is H, and n is 2.
In some embodiments, a compound of Formula (VIII), or a pharmaceutically acceptable salt or isotopic variant thereof, has the structure of:
190
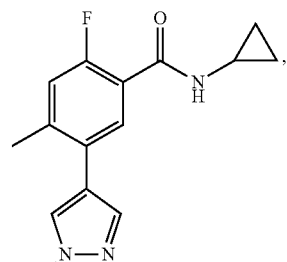
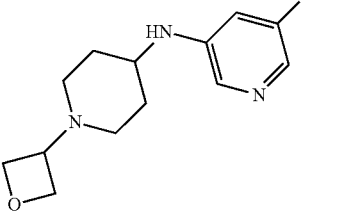
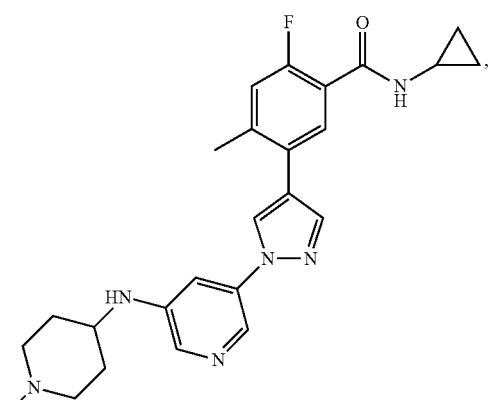
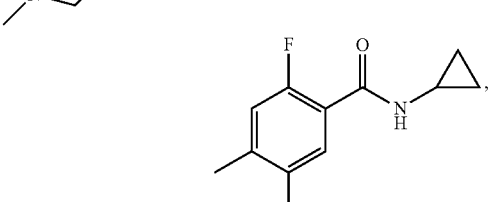
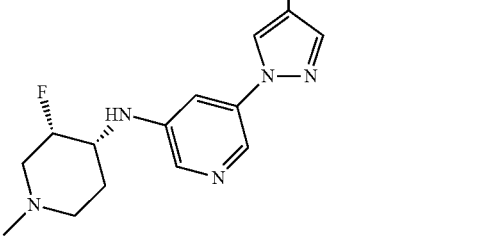

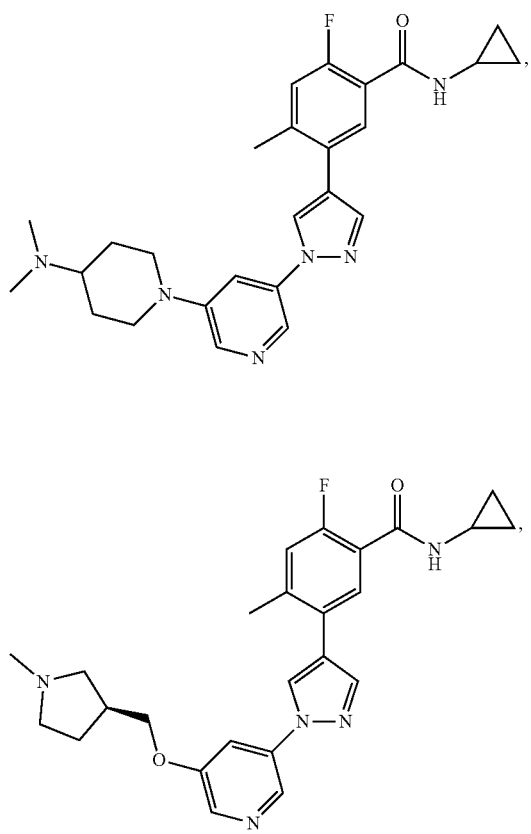
Disclosed herein, are antagonists or partial antagonists of RIPK2 having a structure of Formula (IX), or a pharmaceutically acceptable salt or isotopic variant thereof:
Formula (IX)
wherein
R is —H; or
R is
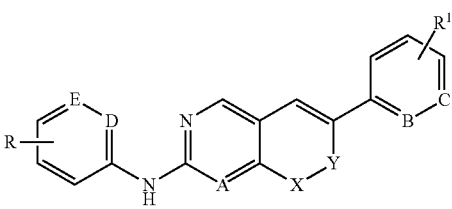
at one available ring position;
A and D are independently N or CH;
E is N, CH, or CR;
B and C are independently N, CH, or C—Cl;

R¹ is H; or

R¹ is C—Cl, C—F, C—OCH₃, C—C(CH₃)₃, or C—OH at one available ring position; and

X—Y are C═C or

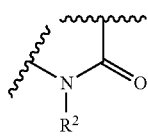

wherein R² is —H, C₁₋₆alkyl, C₁₋₆alkyl-OH, C₁₋₆alkyl-OC₁₋₆ alkyl, or C₁₋₆alkyl-aryl.

In some embodiments, for a compound of Formula (IX), R² is methyl, ethyl, isobutyl, 2-hydroxyethyl, 2-methoxyethyl, benzyl, or phenethyl. In some embodiments, for a compound of Formula (IX), R² is methyl. In some embodiments, for a compound of Formula (IX), R² is ethyl. In some embodiments, for a compound of Formula (IX), R² is isobutyl. In some embodiments, for a compound of Formula (IX), R² is 2-hydroxyethyl. In some embodiments, for a compound of Formula (IX), R² is 2-methoxyethyl. In some embodiments, for a compound of Formula (IX), R² is benzyl. In some embodiments, for a compound of Formula (IX), R² is phenethyl.

In some embodiments, a compound of Formula (IX), or a pharmaceutically acceptable salt and isotopic variant thereof, has the structure of:

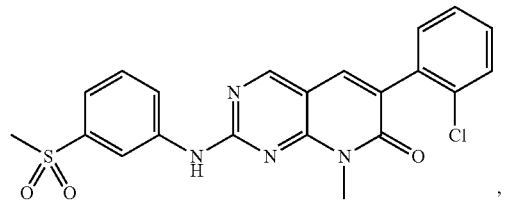

,

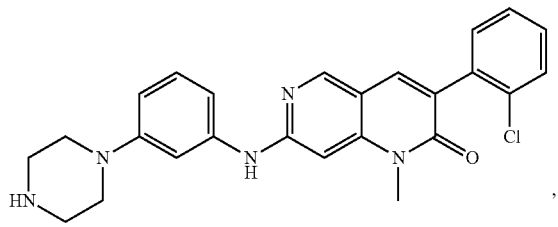

,

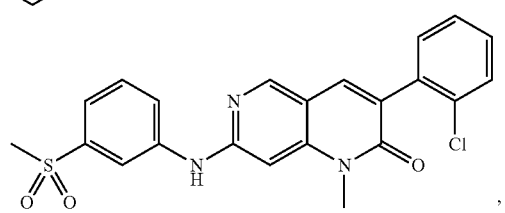

,

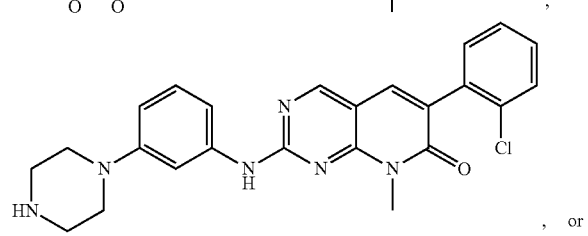

, or

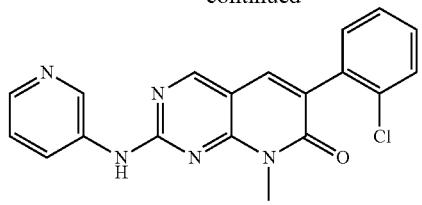

Disclosed herein, are antagonists or partial antagonists of RIPK2 having a structure of Formula (IXa) or a pharmaceutically acceptable salt and isotopic variant thereof:

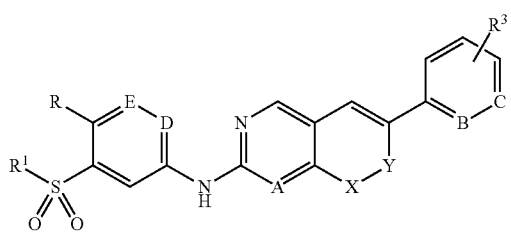

wherein
R is —H,

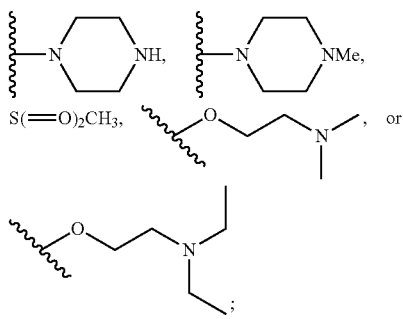

R¹ is C₁₋₆alkyl or 6- to 10-membered aryl;
A and D are independently N or CH;
E is N, CH, or CR;
B and C are independently N, CH, or C—Cl;
R³ is H; or
R³ is C—Cl, C—F, C—OCH₃, C—C(CH₃)₃, or C—OH at one available ring position; and
X—Y are C═C or

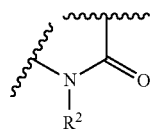

wherein R² is —H, C₁₋₆alkyl, C₁₋₆alkyl-OH, C₁₋₆alkyl-OC₁₋₆alkyl, or C₁₋₆alkyl-aryl.

In some embodiments, for a compound of Formula (IXa), R¹ is methyl, ethyl, or propyl. In some embodiments, for a compound of Formula (IXa), R¹ is methyl. In some embodiments, for a compound of Formula (IXa), R¹ is ethyl. In some embodiments, for a compound of Formula (IXa), R¹ is propyl.

In some embodiments, for a compound of Formula (IXa), $R^2$ is methyl, ethyl, isobutyl, 2-hydroxyethyl, 2-methoxyethyl, benzyl, or phenethyl. In some embodiments, for a compound of Formula (IXa), $R^2$ is methyl. In some embodiments, for a compound of Formula (IXa), $R^2$ is ethyl. In some embodiments, for a compound of Formula (IXa), $R^2$ is isobutyl. In some embodiments, for a compound of Formula (IXa), $R^2$ is 2-hydroxyethyl. In some embodiments, for a compound of Formula (IXa), $R^2$ is 2-methoxyethyl. In some embodiments, for a compound of Formula (IXa), $R^2$ is benzyl. In some embodiments, for a compound of Formula (IXa), $R^2$ is phenethyl.

Disclosed herein, are antagonists or partial antagonists of RIPK2 having a structure of Formula (X), or a pharmaceutically acceptable salt or isotopic variant thereof:

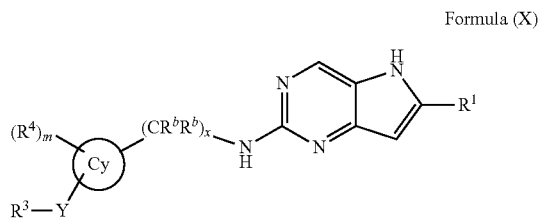

Formula (X)

wherein

Cy is $C_{3-8}$cycloalkyl, $C_{2-9}$heterocycloalkyl, 6- to 10-membered aryl, or $C_{2-9}$heteroaryl;

Y is absent, —$CR^bR^b$—, —O—, —$NR^b$—, or —$S(O)_n$—;

$R^1$ is $C_{3-8}$cycloalkyl, $C_{2-9}$heterocycloalkyl, 6- to 10-membered aryl, or $C_{2-9}$heteroaryl, each of which is optionally substituted with one to three $R^a$;

$R^3$ is —H, $C_{2-9}$heterocycloalkyl, or $C_{2-9}$heteroaryl, wherein the heterocycloalkyl and heteroaryl are optionally substituted with one to three —F, —Cl, —Br, I, —CN, —$NO_2$, —$OR^b$, $C_{1-4}$alkyl, —$C_{1-3}$alkyl-$OR^b$, —$C_{1-3}$alkyl-$NR^bR^b$, $C_{1-4}$haloalkyl, $C_{1-4}$haloalkoxy, $C_{3-8}$cycloalkyl, —$NR^bR^b$, —$C(O)NR^bR^b$, —$NR^bC(O)NR^bR^b$, —$S(O)_nNR^bR^b$, $C(O)OR^b$, —$OC(O)OR^b$, —$S(O)_nR^b$, —$NR^bS(O)_nR^b$, —$C(S)OR^b$, —$OC(S)R^b$, —$NR^bC(O)R^b$, —$C(S)NR^bR^b$, —$NR^bC(S)R^b$, —$NR^bC(O)OR^b$, —$OC(O)NR^bR^b$, —$NR^bC(S)OR^b$, —$OC(S)NR^bR^b$, —$NRC(S)NR^bR^b$, —$C(S)R^b$, or —$C(O)R^b$;

each $R^4$ is independently halogen, —CN, —$NR^bR^b$, —$OR^b$, $C_{1-4}$alkyl, —$C_{1-3}$alkyl-$OR^b$, —$C_{1-3}$alkyl-$NR^bR^b$, $C_{1-4}$haloalkyl, or $C_{1-4}$haloalkoxy;

each $R^a$ is independently —F, —Cl, —Br, I, —CN, $OR^b$, $C_{1-4}$alkyl, $C_{2-6}$alkenyl, $C_{2-6}$alkynyl, $C_{1-4}$haloalkyl, $C_{1-4}$haloalkoxy, —$C_{1-3}$alkyl-$OR^b$, or —$C_{1-3}$alkyl-$NR^bR^b$;

each $R^b$ is independently —H or $C_{1-4}$alkyl;

x is 0, 1, 2, 3, or 4;

each m is independently 0, 1, 2, or 3; and each n is independently 0, 1, or 2.

Disclosed herein, are antagonists or partial antagonists of RIPK2 having a structure of Formula (Xa) or a pharmaceutically acceptable salt or isotopic variant thereof:

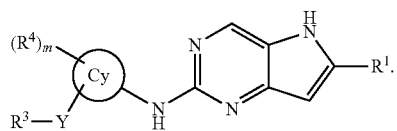

Disclosed herein, are antagonists or partial antagonists of RIPK2 having a structure of Formula (Xb) or a pharmaceutically acceptable salt or isotopic variant thereof:

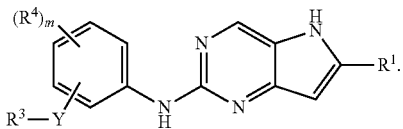

In some embodiments, for a compound of Formula (X), $R^1$ is optionally substituted phenyl, optionally substituted cyclopentyl, optionally substituted cyclohexyl, optionally substituted thienyl, optionally substituted pyridinyl, optionally substituted thiazolyl, optionally substituted pyrrolyl, optionally substituted imidazolyl, optionally substituted furanyl, optionally substituted oxazolyl, optionally substituted isoxazolyl, optionally substituted pyrazolyl, optionally substituted isothiazolyl, optionally substituted pyrmidinyl, optionally substituted pyrazinyl, optionally substituted pyridazinyl, optionally substituted oxadiazolyl, optionally substituted tetrahydropyranyl, optionally substituted triazolyl, or optionally substituted thiadiazolyl. In some embodiments, for a compound of Formula (X), $R^1$ is optionally substituted phenyl, optionally substituted cyclopentyl, optionally substituted thienyl, or optionally substituted tetrahydropyranyl. In some embodiments, for a compound of Formula (X), $R^1$ is optionally substituted phenyl. In some embodiments, for a compound of Formula (X), $R^1$ is optionally substituted cyclopentyl. In some embodiments, for a compound of Formula (X), $R^1$ is optionally substituted thienyl. In some embodiments, for a compound of Formula (X), $R^1$ is optionally substituted tetrahydropyranyl.

In some embodiments, for a compound of Formula (X), $R^3$ is optionally substituted monocyclic heterocycloalkyl or optionally substituted monocyclic heteroaryl. In some embodiments, for a compound of Formula (X), $R^3$ is optionally substituted monocyclic heterocycloalkyl. In some embodiments, for a compound of Formula (X), $R^3$ is optionally substituted monocyclic heterocycloaryl.

In some embodiments, for a compound of Formula (X), m is 0 to 3. In some embodiments, for a compound of Formula (X), m is 0. In some embodiments, for a compound of Formula (X), m is 1. In some embodiments, for a compound of Formula (X), m is 2. In some embodiments, for a compound of Formula (X), m is 3.

In some embodiments, for a compound of Formula (X), $R^3$ is optionally substituted azetidinyl, optionally substituted morpholinyl, optionally substituted piperazinyl, optionally substituted piperidinyl, optionally substituted tetrahydropyranyl, optionally substituted pyrrolidinyl, optionally substituted thiomorpholinyl, optionally substituted tetrahydrofuryanyl, optionally substituted homomorpholinyl, optionally substituted homopiperazinyl, optionally substituted thiomorpholine dioxide, or optionally substituted thienomorpholine oxide. In some embodiments, for a compound of Formula (X), $R^3$ is optionally substituted morpholinyl, optionally substituted piperazinyl, optionally substituted piperidinyl, or optionally substituted thiomorpholinyl. In some embodiments, for a compound of Formula (X), $R^3$ is optionally substituted morpholinyl. In some embodiments, for a compound of Formula (X), $R^3$ is optionally substituted piperazinyl. In some embodiments, for a compound of Formula (X), $R^3$ is optionally substituted piperidinyl. In some embodiments, for a compound of Formula (X), R³ is optionally substituted thiomorpholinyl.

Disclosed herein, are antagonists or partial antagonists of RIPK2 having a structure of Formula (Xc) or a pharmaceutically acceptable salt or isotopic variant thereof:

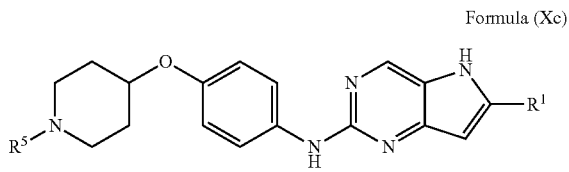

Formula (Xc)

wherein
R⁵ is C₁₋₄alkyl or —C₁₋₃alkyl-OR^b.

Disclosed herein, are antagonists or partial antagonists of RIPK2 having a structure of Formula (Xd) or a pharmaceutically acceptable salt or isotopic variant thereof:

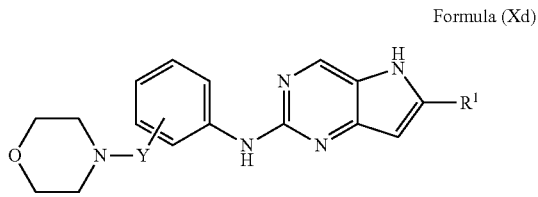

Formula (Xd)

wherein:
Y is absent or —CH₂—; and
Y is attached to the meta or para position of the phenyl ring.

Disclosed herein, are antagonists or partial antagonists of RIPK2 having a structure of Formula (Xe) or a pharmaceutically acceptable salt or isotopic variant thereof:

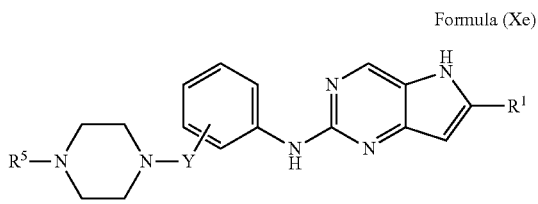

Formula (Xe)

wherein
R⁵ is —H, C₁₋₄alkyl, or —C₁₋₃alkyl-OR^b;
Y is absent or —CH₂—; and
Y is attached to the meta or para position of the phenyl ring.

In some embodiments, for a compound of Formula (X), R¹ is

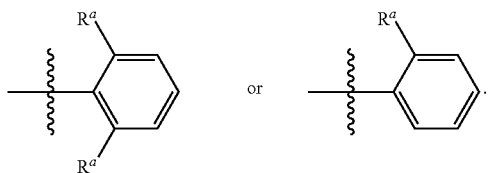

In some embodiments, for a compound of Formula (X), R¹ is

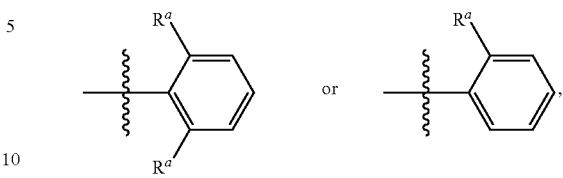

wherein each R^a is independently —F, —Cl, or —CH₃.

Disclosed herein are additional therapeutic agents comprising a modulator of CD30 ligand (CD30L) (Entrez Gene ID: 943). In some embodiments, the modulator of CD30L is an agonist or an antagonist of CD30L. In some instances, the antagonist of CD30L is an inhibitor of CD30L. In some embodiments, an inhibitor of CD30L specifically binds directly or indirectly to CD30L, CD30, or a molecule that interferes directly or indirectly with binding between CD30L and CD30. In some embodiments, as used herein, an inhibitor of CD30L comprises an agent that modulates at least one functional activity of CD30L, such as binding to CD30. Non-limiting examples of inhibitors of CD30L include agents that specifically bind to CD30L, including a polypeptide such as an anti-CD30L antibody or antigen binding fragment thereof, and a nucleic acid, e.g., an antisense construct, siRNA, and ribozyme. An antisense construct includes an expression plasmid that when transcribed in the cell produces RNA complementary to a portion of mRNA encoding CD30L, and an oligonucleotide that inhibits protein expression by hybridizing with the CD30L mRNA. In some embodiments the inhibitor of CD30L comprises a non-polypeptide or non-nucleic acid portion as an active agent that binds to and inhibits CD30L activity.

In some embodiments, an inhibitor of CD30L is a polypeptide that binds to CD30L and/or CD30. In some cases, the polypeptide is a CD30 polypeptide or a portion thereof, wherein the portion retains the ability to bind to CD30L. A portion of a CD30 polypeptide includes at least about 10, 15, 20, 25, 30, 35, 40, 45, or 50 amino acids that have at least about 85%, 90%, or 95% identity to human CD30 having SEQ ID NO: 53, or SEQ ID NO: 54, or a sequence of any CD30 protein-coding isoform (for e.g., P28908). For example, an inhibitor of CD30L comprises a CD30 polypeptide that comprises all or part of the extracellular region of human CD30. In some embodiments, the CD30 polypeptide comprises amino acids 19-390 of SEQ ID NO: 2018 or a binding fragment thereof, having at least about 85%, 90%, or 95% sequence identity to CD30. In some embodiments, the CD30 polypeptide is a homologue of mammalian CD30, e.g., the CD30 polypeptide inhibitor of CD30L is a viral CD30 polypeptide or fragment thereof. As a non-limiting example, the viral CD30 polypeptide comprises viral CD30 from a poxvirus, such as ectromelia virus or cowpox virus.

In a non-limiting example, the inhibitor is an anti-CD30L antibody or an anti-CD30 antibody. As used herein, an antibody includes an antigen-binding fragment of a full length antibody, e.g., a Fab or scFv. In some embodiments, the antibody binds to the extracellular domain of CD30L. In some embodiments, an anti-CD30L antibody comprises a heavy chain comprising three complementarity-determining regions: HCDR1, HCDR2, and HCDR3; and a light chain comprising three complementarity-determining regions: LCDR1, LCDR2, and LCDR3. In some embodiments, the anti-CD30L antibody comprises a HCDR1 comprising SEQ ID NO: 20100, a HCDR2 comprising SEQ ID NO: 20101, a HCDR3 comprising SEQ ID NO: 20102, a LCDR1 comprising SEQ ID NO: 20103, a LCDR2 comprising SEQ ID NO: 20104, and a LCDR3 comprising SEQ ID NO: 20105.

In some embodiments, the anti-CD30L antibody comprises a HCDR1 comprising SEQ ID NO: 20106, a HCDR2 comprising SEQ ID NO: 20107, a HCDR3 comprising SEQ ID NO: 20108, a LCDR1 comprising SEQ ID NO: 20109, a LCDR2 comprising SEQ ID NO: 20110, and a LCDR3 comprising SEQ ID NO: 20111.

In some embodiments, the anti-CD30L antibody comprises a HCDR1 comprising SEQ ID NO: 20112, a HCDR2 comprising SEQ ID NO: 20113, a HCDR3 comprising SEQ ID NO: 20114, a LCDR1 comprising SEQ ID NO: 20115, a LCDR2 comprising SEQ ID NO: 20116, and a LCDR3 comprising SEQ ID NO: 20117.

In some embodiments, the anti-CD30L antibody comprises a HCDR1 comprising SEQ ID NO: 20118, a HCDR2 comprising SEQ ID NO: 20119, a HCDR3 comprising SEQ ID NO: 20120, a LCDR1 comprising SEQ ID NO: 20121, a LCDR2 comprising SEQ ID NO: 20122, and a LCDR3 comprising SEQ ID NO: 20123.

In some embodiments, the anti-CD30L antibody comprises a HCDR1 comprising SEQ ID NO: 20124, a HCDR2 comprising SEQ ID NO: 20125, a HCDR3 comprising SEQ ID NO: 20126, a LCDR1 comprising SEQ ID NO: 20127, a LCDR2 comprising SEQ ID NO: 20128, and a LCDR3 comprising SEQ ID NO: 20129.

In some embodiments, the anti-CD30L antibody comprises a HCDR1 comprising SEQ ID NO: 20130, a HCDR2 comprising SEQ ID NO: 20131, a HCDR3 comprising SEQ ID NO: 20132, a LCDR1 comprising SEQ ID NO: 20133, a LCDR2 comprising SEQ ID NO: 20134, and a LCDR3 comprising SEQ ID NO: 20135.

In some cases, the anti-CD30L antibody comprises a heavy chain (HC) variable domain comprising SEQ ID NO: 20136 and a light chain (LC) variable domain comprising SEQ ID NO: 20137. In some cases, the anti-CD30L antibody comprises a heavy chain (HC) variable domain comprising SEQ ID NO: 20138 and a light chain (LC) variable domain comprising SEQ ID NO: 20139. In some cases, the anti-CD30L antibody comprises a heavy chain (HC) variable domain comprising SEQ ID NO: 20140 and a light chain (LC) variable domain comprising SEQ ID NO: 20141. In some cases, the anti-CD30L antibody comprises a heavy chain (HC) variable domain comprising SEQ ID NO: 20142 and a light chain (LC) variable domain comprising SEQ ID NO: 20143. In some cases, the anti-CD30L antibody comprises a heavy chain (HC) variable domain comprising SEQ ID NO: 20144 and a light chain (LC) variable domain comprising SEQ ID NO: 20145. In some cases, the anti-CD30L antibody comprises a heavy chain (HC) variable domain comprising SEQ ID NO: 20146 and a light chain (LC) variable domain comprising SEQ ID NO: 20154. In some cases, the anti-CD30L antibody comprises a heavy chain (HC) variable domain comprising SEQ ID NO: 20147 and a light chain (LC) variable domain comprising SEQ ID NO: 20154. In some cases, the anti-CD30L antibody comprises a heavy chain (HC) variable domain comprising SEQ ID NO: 20148 and a light chain (LC) variable domain comprising SEQ ID NO: 20154. In some cases, the anti-CD30L antibody comprises a heavy chain (HC) variable domain comprising SEQ ID NO: 20149 and a light chain (LC) variable domain comprising SEQ ID NO: 20154. In some cases, the anti-CD30L antibody comprises a heavy chain (HC) variable domain comprising SEQ ID NO: 20150 and a light chain (LC) variable domain comprising SEQ ID NO: 20154. In some cases, the anti-CD30L antibody comprises a heavy chain (HC) variable domain comprising SEQ ID NO: 20151 and a light chain (LC) variable domain comprising SEQ ID NO: 20154. In some cases, the anti-CD30L antibody comprises a heavy chain (HC) variable domain comprising SEQ ID NO: 20152 and a light chain (LC) variable domain comprising SEQ ID NO: 20154. In some cases, the anti-CD30L antibody comprises a heavy chain (HC) variable domain comprising SEQ ID NO: 20153 and a light chain (LC) variable domain comprising SEQ ID NO: 20154.

In some embodiments, the anti-CD30 antibody comprises a heavy chain variable region comprising SEQ ID NO: 55 and a light chain variable region comprising SEQ ID NO: 56. Non-limiting examples of anti-CD30 antibodies include MDX-60, Ber-H2, SGN-30 (cAC10), Ki-4.dgA, HRS-3/A9, AFM13, and H22xKi-4.

In some embodiments, the anti-CD30 antibody comprises an antibody drug conjugate. As a non-limiting example, the antibody drug conjugate is brentuximab, an anti-CD30 antibody conjugated to monomethyl auristatin E.

TABLE 3

Exemplary CD30 Ligand Antibodies

| Antibody | SEQ ID NO | Sequence |
| --- | --- | --- |
| HCDR1 A1 | 20100 | SYIWS |
| HCDR2 A1 | 20101 | RIYASGNTNYNPSLKS |
| HCDR3 A1 | 20102 | DYRVAGTYYYYGLDV |
| LCDR1 A1 | 20103 | TGTSSDVGVYDYVS |
| LCDR2 A1 | 20104 | EVSNRPS |
| LCDR3 A1 | 20105 | SSYTSRSTWV |
| HCDR1 A2 | 20106 | SYYWT |
| HCDR2 A2 | 20107 | RIYTSGITNYNPSLKS |
| HCDR3 A2 | 20108 | ERVVGASRYYYYGVDV |
| LCDR1 A2 | 20109 | TGTSSDVGLYNYVS |
| LCDR2 A2 | 20110 | EVNNRPS |
| LCDR3 A2 | 20111 | SSYTSSSTWV |
| HCDR1 A3 | 20112 | SYYWT |
| HCDR2 A3 | 20113 | RIYTSGITNYNPSLKS |
| HCDR3 A3 | 20114 | ERVVGASRYYYYGVDV |
| LCDR1 A3 | 20115 | TGTSSDIGLYDYVS |
| LCDR2 A3 | 20116 | EVNNRPS |
| LCDR3 A3 | 20117 | SSYTSSSTWV |
| HCDR1 A4 | 20118 | SYSWS |
| HCDR2 A4 | 20119 | RTSTSGRNNYNPSLKS |
| HCDR3 A4 | 20120 | DFTIAARRYYYYGMDV |
| LCDR1 A4 | 20121 | TGTSSDIGLYNYVS |
| LCDR2 A4 | 20122 | EVINRPS |
| LCDR3 A4 | 20123 | SSYTSSSTWV |
| HCDR1 A5 | 20124 | NNYWS |

TABLE 3-continued

Exemplary CD30 Ligand Antibodies

| Antibody | SEQ ID NO | Sequence |
|---|---|---|
| HCDR2 A5 | 20125 | RVYSSGLTNYKPSLKS |
| HCDR3 A5 | 20126 | ERATVTTRYHYDGMDV |
| LCDR1 A5 | 20127 | TGSSSDIGTYNYVS |
| LCDR2 A5 | 20128 | EVNNRPS |
| LCDR3 A5 | 20129 | SSYSSSSTWV |
| HCDR1 A6 | 20130 | SYYWS |
| HCDR2 A6 | 20131 | RIFASGSTNYNPSLRS |
| HCDR3 A6 | 20132 | ERVGVQDYYHYSGMDV |
| LCDR1 A6 | 20133 | TGTSSDVGLYNYVS |
| LCDR2 A6 | 20134 | EVSKRPS |
| LCDR3 A6 | 20135 | SSYTSSSTWV |
| HC Var 1 | 20136 | QVQLQESGPGLVKPSETLSLTCTVSGGSISSYYWTWIRQPAGKGLEWIGRIYTSGITNYNPSLKSRVTMSVDTSKNQFSLKLSSVTAADTAVYYCARERVVGASRYYYYGVDVWGQGTTVTVSS |
| LC Var 1 | 20137 | QSALTQPASVSGSPGQSITISCTGTSSDVGLYNYVSWYQQHPDKAPKLMIFEVNNRPSGVSNRFSGSNSGNTASLTISGLQAEDEADYYCSSYTSSSTWVFGGGTKLTVL |
| HC Var 2 | 20138 | QVQLQESGPGLVKPSETLSLTCTVSGGSISSYYWTWIRQPAGKGLEWIGRIYTSGITNYNPSLKSRVTMSVDTSKNQFSLKLSSVTAADTAVYYCARERVVGASRYYYYGVDVWGQGTTVTVSS |
| LC Var 2 | 20139 | QSALTQPASVSGSPGQSITISCTGTSSDIGLYDYVSWYQQHPDRAPKLIIFEVNNRPSGVSYRFSGSNSGNTASLTISGLQAEDEADYYCSSYTSSSTWVFGGGTKLTVL |
| HC Var 3 | 20140 | QVQLQESGPGLVKPSETLSLTCTVSGGSISSYSWSWIRQPAGKGLEWIGRTSTSGRNNYNPSLKSRVTMSVDTSKNQFSLKLNSVTAADTAVYYCARDFTIAARRYYYYGMDVWGQGTTVTVSS |
| LC Var 3 | 20141 | QSALTQPASVSGSPGQSITISCTGTSSDIGLYNYVSWYQQHPGKAPKLIYEVINRPSGVSNRFSGSESGNTASLTISGLQAEDEANYYCSSYTSSSTWVFGGGTKLTVL |
| HC Var 4 | 20142 | QVQLQESGPRLVKPSETLSLTCTVSGGSITNNYWSWIRQPAGKGLEWIGRVYSSGLTNYKPSLKSRVTMSVDTSKNQFSLRLNSVTAADTAVYYCARERATVTTRYHYDGMDVWGQGTSVTVSS |
| LC Var 4 | 20143 | QSALTQPASVSGSPGQSITISCTGSSSDIGTYNYVSWYQQYPGKAPELMIYEVNNRPSGVSDRFSGSTSGNTASLTISGLQANDEADYYCSSYSSSTWVFGGGTKLTVL |
| HC Var 5 | 20144 | QVQLQESGPGLVKPSETLSLTCTVSGGSISSYYWSWIRQPAGKGLEWIGRIFASGSTNYNPSLRSRVTMSRDTSKNQFSLKLSSVTAADTAVYYCAKERVGVQDYYHSGMDVWGQGTTVTVSS |
| LC Var 5 | 20145 | QSALTQPASVSGSPGQSITISCTGTSSDVGLYNYVSWYQQPGKAPKLMIYEVSKRPSGVSNRFSGSTSGNTASLTISGLQADDEADYSCSSYTSSSTWVFGGGTKLTVL |
| HC Var 6 | 20146 | QVQLQESGPGLVKPSETLSLTCTVSGGSISSYIWSWIRQPAGKGLEWIGRIYASGNTNYNPSLKSRVTISVDTSKNQFSLKLSSMTAADTAVYYCARDYRVAGTYYYYGLDVWGQGTTVTVSS |
| HC Var 7 | 20147 | QVQLQESGPGLVKPSETLSLTCTVSGGSISSYIWSWIRQPAGKGLEWIGRIYASGNTNYNPSLKSRVTMSVDTSKNQFSLKLSSMTAADTAVYYCARDYRVAGTYYYYGLDVWGQGTTVTVSS |
| HC Var 8 | 20148 | QVQLQESGPGLVKPSETLSLTCTVSGGSISSYIWSWIRQPAGKGLEWIGRIYASGNTNYNPSLKSRVTMSVDTSKNQFSLKLSSVTAADTAVYYCARDYRVAGTYYYYGLDVWGQGTTVTVSS |
| HC Var 9 | 20149 | QVQLQESGPGLVKPSETLSLTCTVSGGSISSYIWSWIRQPAGKGLEWIGRIYASGQTNYNPSLKSRVTMSVDTSKNQFSLKLSSMTAADTAVYYCARDYRVAGTYYYYGLDVWGQGTTVTVSS |
| HC Var 10 | 20150 | QVQLQESGPGLVKPSETLSLTCTVSGGSISSYIWSWIRQPAGKGLEWIGRIYASGQTNYNPSLKSRVTISVDTSKNQFSLKLSSVTAADTAVYYCARDYRVAGTYYYYGLDVWGQGTTVTVSS |
| HC Var 11 | 20151 | QVQLQESGPGLVKPSETLSLTCTVSGGSISSYIWSWIRQPAGKGLEWIGRIYASGNTNYNPSLKSRVTISVDTSKNQFSLKLSSVTAADTAVYYCARDYRVAGTYYYYGLDVWGQGTTVTVSS |
| HC Var 12 | 20152 | QVQLQESGPGLVKPSETLSLTCTVSGGSISSYIWSWIRQPAGKGLEWIGRIYASGQTNYNPSLKSRVTISVDTSKNQFSLKLSSMTAADTAVYYCARDYRVAGTYYYYGLDVWGQGTTVTVSS |
| HC Var 13 | 20153 | QVQLQESGPGLVKPSETLSLTCTVSGGSISSYIWSWIRQPAGKGLEWIGRIYASGQTNYNPSLKSRVTMSVDTSKNQFSLKLSSVTAADTAVYYCARDYRVAGTYYYYGLDVWGQGTTVTVSS |
| LC Var 6-13 | 20154 | QSALTQPASVSGSPGQSITISCTGTSSDVGVYDYVSWYQQHPGKAPKLMIYEVSNRPSGVSNRFSGSKSGNTASLTISGLQTEDEADYYCSSYTSRSTWVFGGGTKLTVL |

Disclosed herein are additional therapeutic agents that are effective to modify expression and/or activity of G-protein coupled receptor 35 (GPR35) (Entrez Gene ID: 2859) (e.g., modulator of GPR35). Alternatively or additionally, compositions, kits and methods disclosed herein may comprise and/or utilize a therapeutic agent or use thereof, wherein the therapeutic agent modifies expression and/or activity of a protein that functions upstream or downstream of a pathway that involves GPR35. In some embodiments, the modulator of GPR35 is effective to increase or activate the activity or expression of GPR35 in the subject (e.g., agonist or partial agonist). In some embodiments, the modulator of GPR35 is effective to decrease or reduce the activity or expression of GPR35 (e.g., antagonist or partial antagonist).

In some instances, the therapeutic agent is an antagonist of GPR35. In some instances, the antagonist acts as an inverse agonist. Non-limiting examples of inverse agonists are ML145 and ML144. In some instances, the therapeutic agent is an allosteric modulator of GPR35. Methods disclosed herein may comprise administering the modulator of GPR35 alone. In other instances, methods disclosed herein may comprise administering the modulator of GPR35 along with another therapeutic agent disclosed herein (e.g., anti-TL1A antibody), a nutritional-based therapy, a nature-based therapy, a diet-based therapy, or a combination thereof.

In some instances, the therapeutic agent is a small molecule drug. By way of non-limiting example, a small molecule drug may be a chemical compound. In some cases, a small molecule has a molecular weight less than about 1,000 Da, or less than about 900 Da, or less than about 800 Da. In some cases, a small molecule has a molecular weight from about 50 Da to about 1,000 Da. In some instances, the therapeutic agent is a large molecule drug. Large molecule drugs generally comprise a peptide or nucleic acid. By way of non-limiting example, the large molecule drug may comprise an antibody or antigen binding antibody fragment. In some instances, the therapeutic agent comprises a small molecule and a large molecule. By way of non-limiting example, the therapeutic agent may comprise an antibody-drug conjugate.

In some instances, the therapeutic agent is a small molecule that binds GPR35. In some instances, the small molecule that binds GPR35 is a GPR35 agonist. In some instances, the small molecule that binds GPR35 is a GPR35 partial agonist. In some instances, the small molecule that binds GPR35 is a GPR35 antagonist. In some instances, the small molecule that binds GPR35 is a GPR35 partial agonist.

In some instances, the small molecule that binds GPR35 is a compound of Formula (I):

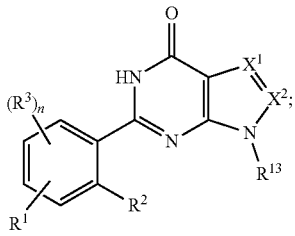

Formula (I)

wherein:
$X^1$ and $X^2$ are independently selected from N and $CR^{14}$;
$R^1$ is —$CH_2R^4$, —CN, —$B(OH)_2$, —$N(R^{10})_2$, —$NR^{10}C(O)R^9$, —C(O)OH, —$CH_2C(O)OH$, —$C(O)N(R^{10})_2$, —$C(O)NHS(O)_2N(R^{10})_2$, —$C_{1-6}$alkyl-OH, $C_{3-8}$cycloalkyl,

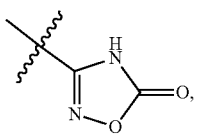 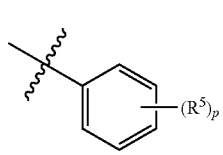

or a 5- or 6-membered heteroaryl optionally substituted with one, two, or three $R^8$ groups;
$R^2$ is H, —OH, —$N(R^{10})_2$, —$NHS(O)_2R^9$, —$S(O)_2N(R^{10})_2$, —$C(O)N(R^{10})_2$, $OC(O)N(R^{10})_2$, —O—$C_{1-6}$alkyl, —$C_{1-6}$alkyl-OH, —$C_{1-6}$alkyl-$OR^9$, —$C_{1-6}$alkyl-N$(R^{10})_2$, $C_{2-6}$alkenyl, $C_{2-6}$alkynyl, $C_{1-6}$haloalkyl, $C_{3-8}$cycloalkyl;

each $R^3$ is independently selected from halogen, —CN, —OH, —$OR^9$, —$SR^9$, —$N(R^{10})_2$, —$S(O)R^9$, —$S(O)_2R^9$, —$NHS(O)_2R^9$, —$S(O)_2N(R^{10})_2$, —$C(O)R^9$, —$C(O)OR^{10}$, —$OC(O)R^9$, —$C(O)N(R^{10})_2$, —$OC(O)N(R^{10})_2$, —$NR^{10}C(O)N(R^{10})_2$, —$NR^{10}C(O)R^9$, —$NR^{10}C(O)OR^9$, $C_{1-6}$alkyl, —$C_{1-6}$alkyl-OH, —$C_{1-6}$alkyl-$OR^9$, —$C_{1-6}$alkyl-N$(R^{10})_2$, $C_{2-6}$alkenyl, $C_{2-6}$alkynyl, $C_{1-6}$haloalkyl, $C_{3-8}$cycloalkyl, and —$C_{1-6}$alkyl-$C_{3-8}$cycloalkyl;

$R^4$ is

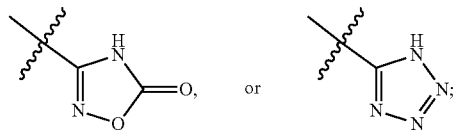 [SMILES: *c1noc(=O)[nH]1 ; "or" ; *c1nnn[nH]1]

each $R^5$ is independently selected from halogen, —CN, —OH, —$OR^9$, —$SR^9$, —$N(R^{10})_2$, —$S(O)R^9$, —$S(O)_2R^9$, —$NHS(O)_2R^9$, —$S(O)_2N(R^{10})_2$, —$C(O)NHS(O)_2N(R^{10})_2$, —$C(O)R^9$, —$C(O)OR^{10}$, —$OC(O)R^9$, —$C(O)N(R^{10})_2$, —$OC(O)N(R^{10})_2$, —$NR^{10}C(O)N(R^{10})_2$, —$NR^{10}C(O)R^9$, —$NR^{10}C(O)OR^9$, $C_{1-6}$alkyl, —$C_{1-6}$alkyl-OH, —$C_{1-6}$alkyl-$OR^9$, —$C_{1-6}$alkyl-N$(R^{10})_2$, —$C_{1-6}$alkyl-$C(O)OR^{10}$, $C_{2-6}$alkenyl, $C_{2-6}$alkynyl, $C_{1-6}$haloalkyl, $C_{1-6}$haloalkyl-OH, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, and $C_{1-9}$heteroaryl; wherein phenyl, —$C_{1-6}$alkyl-phenyl, and $C_{1-9}$heteroaryl are optionally substituted with one, two, or three groups independently selected from halogen, $C_{1-6}$alkyl, $C_{1-6}$haloalkyl, $C_{3-8}$cycloalkyl, and $C_{2-9}$heterocycloalkyl; and wherein $C_{2-9}$heterocycloalkyl is optionally substituted with one, two, or three groups independently selected from halogen, $C_{1-6}$alkyl, $C_{1-6}$haloalkyl, and oxo;

$R^6$ is —$C(O)OR^7$, —$C(O)NHS(O)_2N(R^{10})_2$, each $R^7$ is independently selected from H and $C_{1-6}$alkyl;
each $R^8$ is independently selected from halogen, —OH, —$OR^9$, —$N(R^{10})_2$, —$S(O)R^9$, —$S(O)_2R^9$, —$NHS(O)_2R^9$, —$S(O)_2N(R^{10})_2$, —$C(O)NHS(O)_2N(R^{10})_2$, —$C(O)R^9$, —$C(O)OR^{10}$, —$OC(O)R^9$, —$C(O)N(R^{10})_2$, —$OC(O)N(R^{10})_2$, —$NR^{10}C(O)N(R^{10})_2$, —$NR^{10}C(O)R^9$, —$NR^{10}C(O)OR^9$, $C_{1-6}$alkyl, $C_{1-6}$alkyl-OH, —$C_{1-6}$alkyl-$OR^9$, —$C_{1-6}$alkyl-N$(R^{10})_2$, —$C_{1-6}$alkyl-$C(O)OR^{10}$, $C_{1-6}$haloalkyl, $C_{1-6}$haloalkyl-OH, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, and $C_{1-9}$heteroaryl; wherein phenyl, —$C_{1-6}$alkyl-phenyl, and $C_{1-9}$heteroaryl are optionally substituted with one, two, or three groups independently selected from halogen, $C_{1-6}$alkyl, $C_{1-6}$haloalkyl, $C_{3-8}$cycloalkyl, and $C_{2-9}$heterocycloalkyl; and wherein $C_{2-9}$heterocycloalkyl is optionally substituted with one, two, or three groups independently selected from halogen, $C_{1-6}$alkyl, $C_{1-6}$haloalkyl, and oxo;

each $R^9$ is independently selected from $C_{1-6}$alkyl, $C_{1-6}$haloalkyl, $C_{3-8}$cycloalkyl, —$C_{1-6}$alkyl-$C_{3-8}$ cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, and —$C_{1-6}$alkyl-$C_{2-9}$heteroaryl, wherein $C_{1-6}$alkyl, phenyl, —$C_{1-6}$alkyl-phenyl, —$C_{1-6}$alkyl-$C_{2-9}$heterocycloalkyl, $C_{2-9}$heteroaryl, and —$C_{1-6}$alkyl-$C_{2-9}$heteroaryl are optionally substituted with one or two groups independently selected from $C_{1-6}$alkyl, —$OR^{11}$, —$N(R^{11})_2$, $C_{1-6}$alkyl, $C_{3-8}$cycloalkyl, —$C(O)R^{12}$, and —$C(O)OR^{12}$;

each $R^{10}$ is independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl, wherein $C_{1-6}$alkyl, phenyl, —$C_{1-6}$alkyl-phenyl, and $C_{2-9}$heteroaryl are optionally substituted with one or two groups independently selected from halogen, $C_{1-6}$alkyl, —$N(R^{11})_2$, and —$C(O)OR^{12}$; or two $R^{10}$ and the nitrogen atom to which they are attached are combined to form a 5- or 6-membered heterocycloalkyl ring optionally substituted with one, two, or three groups independently selected from $C_{1-6}$alkyl, oxo, and —$C(O)OH$;

each $R^{11}$ is independently selected from H and $C_{1-6}$alkyl;

$R^{12}$ is independently selected from H and $C_{1-6}$alkyl;

$R^{13}$ is selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl;

each $R^{14}$ is independently selected from $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, and —$C_{1-6}$alkyl-$C_{2-9}$heteroaryl;

n is 0, 1, 2, or 3;

p is 0, 1, 2, 3, 4, or 5; and q is 0, 1, 2, 3, or 4;

or a pharmaceutically acceptable salt or solvate thereof.

In some instances, the small molecule that binds GPR35 is a compound of Formula (II):

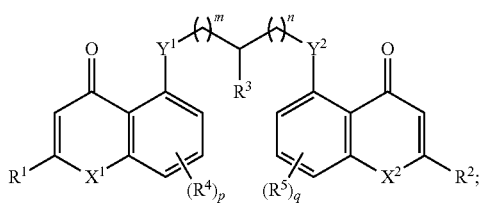

Formula (II)

wherein:

$X^1$, $X^2$, and $Y^2$ are independently selected from O, $NR^{13}$, and $C(R^{14})_2$;

$R^1$ and $R^2$ are independently selected from —$S(O)R^9$, —$S(O)_2R^9$, —$NHS(O)_2R^9$, —$S(O)_2N(R^{10})_2$, —$C(O)R^9$, —$C(O)OR^{10}$, —$OC(O)R^9$, —$C(O)N(R^{10})_2$, —$OC(O)N(R^{10})_2$, —$NR^{10}C(O)N(R^{10})_2$, —$NR^{10}C(O)R^9$, —$NR^{10}C(O)OR^9$, $C_{1-6}$alkyl, —$C_{1-6}$alkyl-OH, —$C_{1-6}$alkyl-$OR^9$, and —$C_{1-6}$alkyl-$N(R^{10})_2$;

$R^3$ is selected from —OH, —$OR^9$, —$SR^9$, —$N(R^{10})_2$, —$S(O)R^9$, —$S(O)_2R^9$, —$NHS(O)_2R^9$, —$S(O)_2N(R^{10})_2$, —$C(O)R^9$, —$C(O)OR^{10}$, —$OC(O)R^9$, —$C(O)$ $N(R^{10})_2$, —$OC(O)N(R^{10})_2$, —$NR^{10}C(O)N(R^{10})_2$, —$NR^{10}C(O)R^9$, —$NR^{10}C(O)OR^9$, $C_{1-6}$alkyl, —$C_{1-6}$alkyl-OH, —$C_{1-6}$alkyl-$OR^9$, —$C_{1-6}$alkyl-$N(R^{10})_2$, $C_{2-6}$alkenyl, $C_{2-6}$alkynyl, $C_{1-6}$haloalkyl, $C_{3-8}$cycloalkyl, and —$C_{1-6}$alkyl-$C_{3-8}$cycloalkyl;

each $R^4$ and $R^5$ is independently selected from halogen, —CN, —OH, —$OR^9$, —$SR^9$, —$N(R^{10})_2$, —$S(O)R^9$, —$S(O)_2R^9$, —$NHS(O)_2R^9$, —$S(O)_2N(R^{10})_2$, —$C(O)R^9$, —$C(O)OR^{10}$, —$OC(O)R^9$, —$C(O)N(R^{10})_2$, —$OC(O)N(R^{10})_2$, —$NR^{10}C(O)N(R^{10})_2$, —$NR^{10}C(O)R^9$, —$NR^{10}C(O)OR^9$, $C_{1-6}$alkyl, —$C_{1-6}$alkyl-OH, —$C_{1-6}$alkyl-$OR^9$, —$C_{1-6}$alkyl-$N(R^{10})_2$, $C_{2-6}$alkenyl, $C_{2-6}$alkynyl, $C_{1-6}$haloalkyl, $C_{3-8}$cycloalkyl, and —$C_{1-6}$alkyl-$C_{3-8}$cycloalkyl;

each $R^9$ is independently selected from $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, and —$C_{1-6}$alkyl-$C_{2-9}$heteroaryl, wherein $C_{1-6}$alkyl, phenyl, —$C_{1-6}$alkyl-phenyl, —$C_{1-6}$alkyl-$C_{2-9}$heterocycloalkyl, $C_{2-9}$heteroaryl, and —$C_{1-6}$alkyl-$C_{2-9}$heteroaryl are optionally substituted with one or two groups independently selected from $C_{1-6}$alkyl, —$OR^{11}$, —$N(R^{11})_2$, $C_{1-6}$alkyl, $C_{3-8}$cycloalkyl, —$C(O)R^{12}$, and —$C(O)OR^{12}$;

each $R^{10}$ is independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl, wherein $C_{1-6}$alkyl, phenyl, —$C_{1-6}$alkyl-phenyl, and $C_{2-9}$heteroaryl are optionally substituted with one or two groups independently selected from halogen, $C_{1-6}$alkyl, and —$N(R^{11})_2$; or two $R^{10}$ and the nitrogen atom to which they are attached are combined to form a 5- or 6-membered heterocycloalkyl ring optionally substituted with one, two, or three groups independently selected from $C_{1-6}$alkyl, oxo, and —$C(O)OH$;

each $R^{11}$ is independently selected from H and $C_{1-6}$alkyl;

each $R^{12}$ is independently selected from H and $C_{1-6}$alkyl;

each $R^{13}$ is independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl;

each $R^{14}$ is independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, and —$C_{1-6}$alkyl-$C_{2-9}$heteroaryl;

m is 1, 2, 3, 4, or 5;

n is 1, 2, 3, 4, or 5;

p is 0, 1, 2, or 3; and q is 0, 1, 2, or 3;

or a pharmaceutically acceptable salt or solvate thereof.

In some instances, the small molecule that binds GPR35 is a compound of Formula (III):

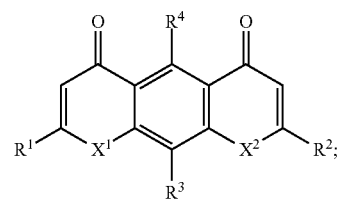

Formula (III)

wherein:

$X^1$ and $X^2$ are independently selected from O, $NR^{13}$, and $C(R^{14})_2$;

$R^1$ and $R^2$ are independently selected from —S(O)$R^9$, —S(O)$_2R^9$, —NHS(O)$_2R^9$, —S(O)$_2$N($R^{10}$)$_2$, —C(O)$R^9$, —C(O)O$R^{10}$, —OC(O)$R^9$, —C(O)N($R^{10}$)$_2$, —OC(O)N($R^{10}$)$_2$, —N$R^{10}$C(O)N($R^{10}$)$_2$, —N$R^{10}$C(O)$R^9$, —N$R^{10}$C(O)O$R^9$, $C_{1-6}$alkyl, —$C_{1-6}$alkyl-OH, —$C_{1-6}$alkyl-O$R^9$, and —$C_{1-6}$alkyl-N($R^{10}$)$_2$;

$R^3$ and $R^4$ are independently selected from H, halogen, —CN, —OH, —O$R^9$, —S$R^9$, —N($R^{10}$)$_2$, —S(O)$R^9$, —S(O)$_2R^9$, —NHS(O)$_2R^9$, —S(O)$_2$N($R^{10}$)$_2$, —C(O)$R^9$, —C(O)O$R^{10}$, —OC(O)$R^9$, —C(O)N($R^{10}$)$_2$, —OC(O)N($R^{10}$)$_2$, —N$R^{10}$C(O)N($R^{10}$)$_2$, —N$R^{10}$C(O)$R^9$, —N$R^{10}$C(O)O$R^9$, $C_{1-6}$alkyl, —$C_{1-6}$alkyl-OH, —$C_{1-6}$alkyl-O$R^9$, —$C_{1-6}$alkyl-N($R^{10}$)$_2$, $C_{2-6}$alkenyl, $C_{2-6}$alkynyl, $C_{1-6}$haloalkyl, $C_{3-8}$cycloalkyl, and —$C_{1-6}$alkyl-$C_{3-8}$cycloalkyl;

each $R^9$ is independently selected from $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, and —$C_{1-6}$alkyl-$C_{2-9}$heteroaryl, wherein $C_{1-6}$alkyl, phenyl, —$C_{1-6}$alkyl-phenyl, —$C_{1-6}$alkyl-$C_{2-9}$heterocycloalkyl, $C_{2-9}$heteroaryl, and —$C_{1-6}$alkyl-$C_{2-9}$heteroaryl are optionally substituted with one or two groups independently selected from $C_{1-6}$alkyl, —O$R^{11}$, —N($R^{11}$)$_2$, $C_{1-6}$alkyl, $C_{3-8}$cycloalkyl, —C(O)$R^{12}$, and —C(O)O$R^{12}$;

each $R^{10}$ is independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl, wherein $C_{1-6}$alkyl, phenyl, —$C_{1-6}$alkyl-phenyl, and $C_{2-9}$heteroaryl are optionally substituted with one or two groups independently selected from halogen, $C_{1-6}$alkyl, and —N($R^{11}$)$_2$; or two $R^{10}$ and the nitrogen atom to which they are attached are combined to form a 5- or 6-membered heterocycloalkyl ring optionally substituted with one, two, or three groups independently selected from $C_{1-6}$alkyl, oxo, and —C(O)OH;

each $R^{11}$ is independently selected from H and $C_{1-6}$alkyl;

each $R^{12}$ is independently selected from H and $C_{1-6}$alkyl;

each $R^{13}$ is independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl; and each $R^{14}$ is independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, and —$C_{1-6}$alkyl-$C_{2-9}$heteroaryl;

or a pharmaceutically acceptable salt or solvate thereof.

In some instances, the small molecule that binds GPR35 is a compound of Formula (IV):

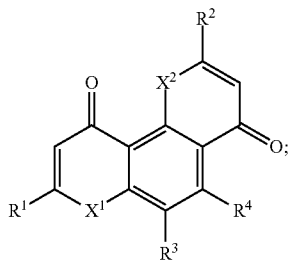

Formula (IV)

wherein:

$X^1$ and $X^2$ are independently selected from O, $NR^{13}$, and $C(R^{14})_2$;

$R^1$ and $R^2$ are independently selected from —S(O)$R^9$, —S(O)$_2R^9$, —NHS(O)$_2R^9$, —S(O)$_2$N($R^{10}$)$_2$, —C(O)$R^9$, —C(O)O$R^{10}$, —OC(O)$R^9$, —C(O)N($R^{10}$)$_2$, —OC(O)N($R^{10}$)$_2$, —N$R^{10}$C(O)N($R^{10}$)$_2$, —N$R^{10}$C(O)$R^9$, —N$R^{10}$C(O)O$R^9$, $C_{1-6}$alkyl, —$C_{1-6}$alkyl-OH, —$C_{1-6}$alkyl-O$R^9$, and —$C_{1-6}$alkyl-N($R^{10}$)$_2$;

$R^3$ and $R^4$ are independently selected from H, halogen, —CN, —OH, —O$R^9$, —S$R^9$, —N($R^{10}$)$_2$, —S(O)$R^9$, —S(O)$_2R^9$, —NHS(O)$_2R^9$, —S(O)$_2$N($R^{10}$)$_2$, —C(O)$R^9$, —C(O)O$R^{10}$, —OC(O)$R^9$, —C(O)N($R^{10}$)$_2$, —OC(O)N($R^{10}$)$_2$, —N$R^{10}$C(O)N($R^{10}$)$_2$, —N$R^{10}$C(O)$R^9$, —N$R^{10}$C(O)O$R^9$, $C_{1-6}$alkyl, —$C_{1-6}$alkyl-OH, —$C_{1-6}$alkyl-O$R^9$, —$C_{1-6}$alkyl-N($R^{10}$)$_2$, $C_{2-6}$alkenyl, $C_{2-6}$alkynyl, $C_{1-6}$haloalkyl, $C_{3-8}$cycloalkyl, and —$C_{1-6}$alkyl-$C_{3-8}$cycloalkyl;

each $R^9$ is independently selected from $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, and —$C_{1-6}$alkyl-$C_{2-9}$heteroaryl, wherein $C_{1-6}$alkyl, phenyl, —$C_{1-6}$alkyl-phenyl, —$C_{1-6}$alkyl-$C_{2-9}$heterocycloalkyl, $C_{2-9}$heteroaryl, and —$C_{1-6}$alkyl-$C_{2-9}$heteroaryl are optionally substituted with one or two groups independently selected from $C_{1-6}$alkyl, —O$R^{11}$, —N($R^{11}$)$_2$, $C_{1-6}$alkyl, $C_{3-8}$cycloalkyl, —C(O)$R^{12}$, and —C(O)O$R^{12}$;

each $R^{10}$ is independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl, wherein $C_{1-6}$alkyl, phenyl, —$C_{1-6}$alkyl-phenyl, and $C_{2-9}$heteroaryl are optionally substituted with one or two groups independently selected from halogen, $C_{1-6}$alkyl, and —N($R^{11}$)$_2$; or two $R^{10}$ and the nitrogen atom to which they are attached are combined to form a 5- or 6-membered heterocycloalkyl ring optionally substituted with one, two, or three groups independently selected from $C_{1-6}$alkyl, oxo, and —C(O)OH;

each $R^{11}$ is independently selected from H and $C_{1-6}$alkyl;

each $R^{12}$ is independently selected from H and $C_{1-6}$alkyl;

each $R^{13}$ is independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl; and each $R^{14}$ is independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, and —$C_{1-6}$alkyl-$C_{2-9}$heteroaryl;

or a pharmaceutically acceptable salt or solvate thereof.

In some instances, the small molecule that binds GPR35 is a compound of Formula (V):

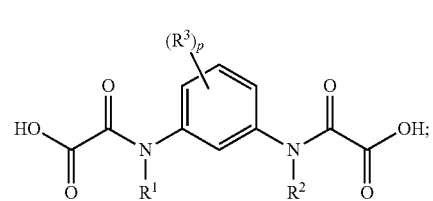

Formula (V)

wherein:

$R^1$ and $R^2$ are independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl;

each $R^3$ is independently selected from halogen, —CN, —OH, —$OR^9$, —$SR^9$, —$N(R^{10})_2$, —$S(O)R^9$, —$S(O)_2R^9$, —$NHS(O)_2R^9$, —$S(O)_2N(R^{10})_2$, —$C(O)R^9$, —$C(O)OR^{10}$, —$OC(O)R^9$, —$C(O)N(R^{10})_2$, —$OC(O)N(R^{10})_2$, —$NR^{10}C(O)N(R^{10})_2$, —$NR^{10}C(O)R^9$, —$NR^{10}C(O)OR^9$, $C_{1-6}$alkyl, —$C_{1-6}$alkyl-OH, —$C_{1-6}$alkyl-$OR^9$, —$C_{1-6}$alkyl-$N(R^{10})_2$, $C_{2-6}$alkenyl, $C_{2-6}$alkynyl, $C_{1-6}$haloalkyl, $C_{3-8}$cycloalkyl, and —$C_{1-6}$alkyl-$C_{3-8}$cycloalkyl;

each $R^9$ is independently selected from $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$ heterocycloalkyl, $C_{2-9}$heteroaryl, and —$C_{1-6}$alkyl-$C_{2-9}$heteroaryl, wherein $C_{1-6}$alkyl, phenyl, —$C_{1-6}$alkyl-phenyl, —$C_{1-6}$alkyl-$C_{2-9}$heterocycloalkyl, $C_{2-9}$heteroaryl, and —$C_{1-6}$alkyl-$C_{2-9}$heteroaryl are optionally substituted with one or two groups independently selected from $C_{1-6}$alkyl, —$OR^{11}$, —$N(R^{11})_2$, $C_{1-6}$alkyl, $C_{3-8}$cycloalkyl, —$C(O)R^{12}$, and —$C(O)OR^{12}$;

each $R^{10}$ is independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl, wherein $C_{1-6}$alkyl, phenyl, —$C_{1-6}$alkyl-phenyl, and $C_{2-9}$heteroaryl are optionally substituted with one or two groups independently selected from halogen, $C_{1-6}$alkyl, and —$N(R^{11})_2$; or two $R^{10}$ and the nitrogen atom to which they are attached are combined to form a 5- or 6-membered heterocycloalkyl ring optionally substituted with one, two, or three groups independently selected from $C_{1-6}$alkyl, oxo, and —C(O)OH;

each $R^{11}$ is independently selected from H and $C_{1-6}$alkyl;
each $R^{12}$ is independently selected from H and $C_{1-6}$alkyl; and
p is 0, 1, 2, 3, or 4;

or a pharmaceutically acceptable salt or solvate thereof.

In some instances, the small molecule that binds GPR35 is a compound of Formula (VI):

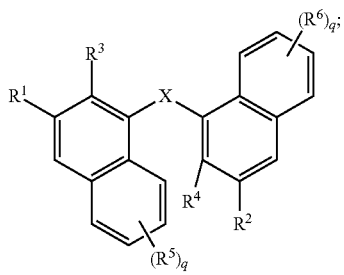

Formula (IV)

wherein:

$X^1$ and $X^2$ are independently selected from O, $NR^{13}$, and $C(R^{14})_2$;

$R^1$ and $R^2$ are independently selected from —$S(O)R^9$, —$S(O)_2R^9$, —$NHS(O)_2R^9$, —$S(O)_2N(R^{10})_2$, —$C(O)R^9$, —$C(O)OR^{10}$, —$OC(O)R^9$, —$C(O)N(R^{10})_2$, —$OC(O)N(R^{10})_2$, —$NR^{10}C(O)N(R^{10})_2$, —$NR^{10}C(O)R^9$, —$NR^{10}C(O)OR^9$, $C_{1-6}$alkyl, —$C_{1-6}$alkyl-OH, —$C_{1-6}$alkyl-$OR^9$, and —$C_{1-6}$alkyl-$N(R^{10})_2$;

$R^3$ and $R^4$ are independently selected from H, halogen, —CN, —OH, —$OR^9$, —$SR^9$, —$N(R^{10})_2$, —$S(O)R^9$, —$S(O)_2R^9$, —$NHS(O)_2R^9$, —$S(O)_2N(R^{10})_2$, —$C(O)R^9$, —$C(O)OR^{10}$, —$OC(O)R^9$, —$C(O)N(R^{10})_2$, —$OC(O)N(R^{10})_2$, —$NR^{10}CC(O)N(R^{10})_2$, —$NR^{10}C(O)R^9$, —$NR^{10}C(O)OR^9$, $C_{1-6}$ alkyl, —$C_{1-6}$alkyl-OH, —$C_{1-6}$alkyl-$OR^9$, —$C_{1-6}$alkyl-$N(R^{10})_2$, $C_{2-6}$alkenyl, $C_{2-6}$alkynyl, $C_{1-6}$haloalkyl, $C_{3-8}$cycloalkyl, and —$C_{1-6}$alkyl-$C_{3-8}$cycloalkyl;

each $R^9$ is independently selected from $C_{1-6}$alkyl, $C_{1-6}$haloalkyl, $C_{3-8}$cycloalkyl, —$C_{1-6}$alkyl-$C_{3-8}$ cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, and —$C_{1-6}$alkyl-$C_{2-9}$heteroaryl, wherein $C_{1-6}$alkyl, phenyl, —$C_{1-6}$alkyl-phenyl, —$C_{1-6}$alkyl-$C_{2-9}$heterocycloalkyl, $C_{2-9}$heteroaryl, and —$C_{1-6}$alkyl-$C_{2-9}$heteroaryl are optionally substituted with one or two groups independently selected from $C_{1-6}$alkyl, —$OR^{11}$, —$N(R^{11})_2$, $C_{1-6}$alkyl, $C_{3-8}$cycloalkyl, —$C(O)R^{12}$, and —$C(O)OR^{12}$;

each $R^{10}$ is independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl, wherein $C_{1-6}$alkyl, phenyl, —$C_{1-6}$alkyl-phenyl, and $C_{2-9}$heteroaryl are optionally substituted with one or two groups independently selected from halogen, $C_{1-6}$alkyl, and —$N(R^{11})_2$; or two $R^{10}$ and the nitrogen atom to which they are attached are combined to form a 5- or 6-membered heterocycloalkyl ring optionally substituted with one, two, or three groups independently selected from $C_{1-6}$alkyl, oxo, and —C(O)OH;

each $R^{11}$ is independently selected from H and $C_{1-6}$alkyl;
each $R^{12}$ is independently selected from H and $C_{1-6}$alkyl;
each $R^{13}$ is independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl; and
each $R^{14}$ is independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, $C_{1-6}$alkyl-$C_{2-9}$heterocycloalkyl, $C_{2-9}$heteroaryl, and —$C_{1-6}$alkyl-$C_{2-9}$heteroaryl;

or a pharmaceutically acceptable salt or solvate thereof.

In some instances, the small molecule that binds GPR35 is a compound of Formula (V):

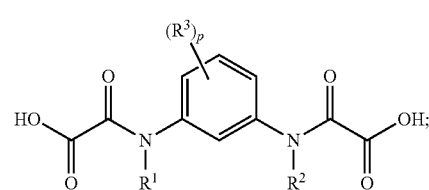

Formula (V)

wherein:

$R^1$ and $R^2$ are independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl;

each $R^3$ is independently selected from halogen, —CN, —OH, —$OR^9$, —$SR^9$, —$N(R^{10})_2$, —$S(O)R^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C(O)N(R$^{10}$)$_2$, —NR$^{10}$C(O)R$^9$, —NR$^{10}$C(O)OR$^9$, C$_{1-6}$alkyl, —C$_{1-6}$alkyl-OH, —C$_{1-6}$alkyl-OR$^9$, —C$_{1-6}$alkyl-N(R$^{10}$)$_2$, C$_{2-6}$alkenyl, C$_{2-6}$alkynyl, C$_{1-6}$haloalkyl, C$_{3-8}$cycloalkyl, and —C$_{1-6}$alkyl-C$_{3-8}$cycloalkyl;

each R$^9$ is independently selected from C$_{1-6}$alkyl, C$_{1-6}$haloalkyl, C$_{3-8}$cycloalkyl, —C$_{1-6}$alkyl-C$_{3-8}$ cycloalkyl, phenyl, —C$_{1-6}$alkyl-phenyl, C$_{2-9}$heterocycloalkyl, —C$_{1-6}$alkyl-C$_{2-9}$heterocycloalkyl, C$_{2-9}$heteroaryl, and —C$_{1-6}$alkyl-C$_{2-9}$heteroaryl, wherein C$_{1-6}$alkyl, phenyl, —C$_{1-6}$alkyl-phenyl, —C$_{1-6}$alkyl-C$_{2-9}$heterocycloalkyl, C$_{2-9}$heteroaryl, and —C$_{1-6}$alkyl-C$_{2-9}$heteroaryl are optionally substituted with one or two groups independently selected from C$_{1-6}$alkyl, —OR$^{11}$, —N(R$^{11}$)$_2$, C$_{1-6}$alkyl, C$_{3-8}$cycloalkyl, —C(O)R$^{12}$, and —C(O)OR$^{12}$;

each R$^{10}$ is independently selected from H, C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, and C$_{2-9}$heteroaryl, wherein C$_{1-6}$alkyl, phenyl, —C$_{1-6}$alkyl-phenyl, and C$_{2-9}$heteroaryl are optionally substituted with one or two groups independently selected from halogen, C$_{1-6}$alkyl, and —N(R$^{11}$)$_2$; or two R$^{10}$ and the nitrogen atom to which they are attached are combined to form a 5- or 6-membered heterocycloalkyl ring optionally substituted with one, two, or three groups independently selected from C$_{1-6}$alkyl, oxo, and —C(O)OH;

each R$^{11}$ is independently selected from H and C$_{1-6}$alkyl;
each R$^{12}$ is independently selected from H and C$_{1-6}$alkyl; and
p is 0, 1, 2, 3, or 4;
or a pharmaceutically acceptable salt or solvate thereof.

In some instances, the small molecule that binds GPR35 is a compound of Formula (VII):

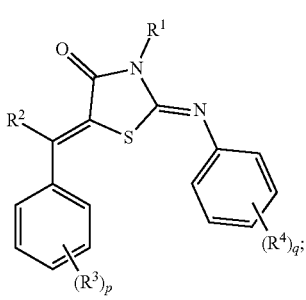

Formula (VII)

R$^1$ is selected from H, C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, and C$_{2-9}$heteroaryl;

R$^2$ is selected from H, halogen, —CN, —OH, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C(O)N(R$^{10}$)$_2$, —NR$^{10}$C(O)R$^9$, —NR$^{10}$C(O)OR$^9$, C$_{1-6}$alkyl, —C$_{1-6}$alkyl-OH, —C$_{1-6}$alkyl-OR$^9$, —C$_{1-6}$alkyl-N(R$^{10}$)$_2$, C$_{2-6}$alkenyl, C$_{2-6}$alkynyl, C$_{1-6}$haloalkyl, C$_{3-8}$cycloalkyl, and —C$_{1-6}$alkyl-C$_{3-8}$cycloalkyl;

each R$^3$ and each R$^4$ is independently selected from halogen, —CN, —OH, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C(O)N(R$^{10}$)$_2$, —NR$^{10}$C(O)R$^9$, —NR$^{10}$C(O)OR$^9$, C$_{1-6}$alkyl, —C$_{1-6}$alkyl-OH, —C$_{1-6}$alkyl-OR$^9$, —C$_{1-6}$alkyl-N(R$^{10}$)$_2$, C$_{2-6}$alkenyl, C$_{2-6}$alkynyl, C$_{1-6}$haloalkyl, C$_{3-8}$cycloalkyl, and —C$_{1-6}$alkyl-C$_{3-8}$cycloalkyl;

each R$^9$ is independently selected from C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, C$_{2-9}$heterocycloalkyl, —C$_{1-6}$alkyl-C$_{2-9}$heterocycloalkyl, C$_{2-9}$heteroaryl, and —C$_{1-6}$alkyl-C$_{2-9}$heteroaryl, wherein C$_{1-6}$alkyl, phenyl, —C$_{1-6}$alkyl-phenyl, —C$_{1-6}$alkyl-C$_{2-9}$heterocycloalkyl, C$_{2-9}$heteroaryl, and —C$_{1-6}$alkyl-C$_{2-9}$heteroaryl are optionally substituted with one or two groups independently selected from C$_{1-6}$alkyl, —OR$^{11}$, —N(R$^{11}$)$_2$, C$_{1-6}$alkyl, C$_{3-8}$cycloalkyl, —C(O)R$^{12}$, and —C(O)OR$^{12}$;

each R$^{10}$ is independently selected from H, C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, and C$_{2-9}$heteroaryl, wherein C$_{1-6}$alkyl, phenyl, —C$_{1-6}$alkyl-phenyl, and C$_{2-9}$heteroaryl are optionally substituted with one or two groups independently selected from halogen, C$_{1-6}$alkyl, and —N(R$^{11}$)$_2$; or two R$^{10}$ and the nitrogen atom to which they are attached are combined to form a 5- or 6-membered heterocycloalkyl ring optionally substituted with one, two, or three groups independently selected from C$_{1-6}$alkyl, oxo, and —C(O)OH;

each R$^{11}$ is independently selected from H and C$_{1-6}$alkyl;
each R$^{12}$ is independently selected from H and C$_{1-6}$alkyl;
p is 0, 1, 2, 3, or 4; and
q is 0, 1, 2, 3, or 4;
or a pharmaceutically acceptable salt or solvate thereof.

In some instances, the small molecule that binds GPR35 is a compound of Formula (VIII):

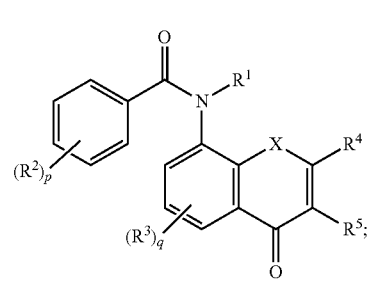

Formula (VIII)

wherein:

X is selected from —O—, —S—, and —SO$_2$—;

R$^1$ is selected from H, C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, and C$_{2-9}$heteroaryl;

each R$^2$ and each R$^3$ is independently selected from halogen, —CN, —OH, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C(O)N(R$^{10}$)$_2$, —NR$^{10}$C(O)R$^9$, —NR$^{10}$C(O)OR$^9$, C$_{1-6}$alkyl, —C$_{1-6}$alkyl-OH, —C$_{1-6}$alkyl-OR$^9$, —C$_{1-6}$alkyl-N(R$^{10}$)$_2$, C$_{2-6}$alkenyl, C$_{2-6}$alkynyl, C$_{1-6}$haloalkyl, C$_{3-8}$cycloalkyl, and —C$_{1-6}$alkyl-C$_{3-8}$cycloalkyl;

$R^4$ is selected from —C(O)OH, —C(O)OR$^{10}$,

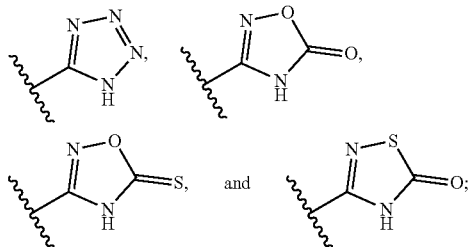

$R^5$ is selected from H, halogen, —CN, —OH, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C(O)N(R$^{10}$)$_2$, —NR$^{10}$C(O)R$^9$, —NR$^{10}$C(O)OR$^9$, C$_{1-6}$alkyl, —C$_{1-6}$alkyl-OH, —C$_{1-6}$alkyl-OR$^9$, —C$_{1-6}$alkyl-N(R$^{10}$)$_2$, C$_{2-6}$alkenyl, C$_{2-6}$alkynyl, C$_{1-6}$haloalkyl, C$_{3-8}$cycloalkyl, and —C$_{1-6}$alkyl-C$_{3-8}$cycloalkyl;

each R$^9$ is independently selected from C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, C$_{2-9}$heterocycloalkyl, —C$_{1-6}$alkyl-C$_{2-9}$heterocycloalkyl, C$_{2-9}$heteroaryl, and —C$_{1-6}$alkyl-C$_{2-9}$heteroaryl, wherein C$_{1-6}$alkyl, phenyl, —C$_{1-6}$alkyl-phenyl, —C$_{1-6}$alkyl-C$_{2-9}$heterocycloalkyl, C$_{2-9}$heteroaryl, and —C$_{1-6}$alkyl-C$_{2-9}$heteroaryl are optionally substituted with one or two groups independently selected from C$_{1-6}$alkyl, —OR$^{11}$, —N(R$^{11}$)$_2$, C$_{1-6}$alkyl, C$_{3-8}$cycloalkyl, —C(O)R$^{12}$, and —C(O)OR$^{12}$;

each R$^{10}$ is independently selected from H, C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, and C$_{2-9}$heteroaryl, wherein C$_{1-6}$alkyl, phenyl, —C$_{1-6}$alkyl-phenyl, and C$_{2-9}$heteroaryl are optionally substituted with one or two groups independently selected from halogen, C$_{1-6}$alkyl, and —N(R$^{11}$)$_2$; or two R$^{10}$ and the nitrogen atom to which they are attached are combined to form a 5- or 6-membered heterocycloalkyl ring optionally substituted with one, two, or three groups independently selected from C$_{1-6}$alkyl, oxo, and —C(O)OH;

each R$^{11}$ is independently selected from H and C$_{1-6}$alkyl;
each R$^{12}$ is independently selected from H and C$_{1-6}$alkyl;
p is 0, 1, 2, 3, or 4; and
q is 0, 1, 2, or 3;
or a pharmaceutically acceptable salt or solvate thereof.

In some instances, the small molecule that binds GPR35 is a compound of Formula (IX):

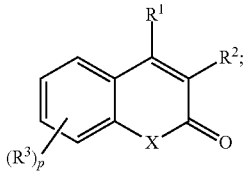

Formula (IX)

wherein:
X is selected from —O— and —S—;
R$^1$ is selected from H, halogen, —CN, —OH, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C(O)N(R$^{10}$)$_2$, —NR$^{10}$C(O)R$^9$, —NR$^{10}$C(O)OR$^9$, C$_{1-6}$alkyl, —C$_{1-6}$alkyl-OH, —C$_{1-6}$alkyl-OR$^9$, —C$_{1-6}$alkyl-N(R$^{10}$)$_2$, C$_{2-6}$alkenyl, C$_{2-6}$alkynyl, C$_{1-6}$haloalkyl, C$_{3-8}$cycloalkyl, and —C$_{1-6}$alkyl-C$_{3-8}$cycloalkyl;

R$^2$ is selected from —C(O)OH, —C(O)OR$^{10}$,

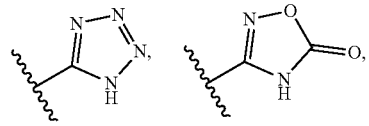

each R$^3$ is independently selected from halogen, —CN, —OH, NO$_2$, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C(O)N(R$^{10}$)$_2$, —NR$^{10}$C(O)R$^9$, —NR$^{10}$C(O)OR$^9$, C$_{1-6}$alkyl, —C$_{1-6}$alkyl-OH, —C$_{1-6}$alkyl-OR$^9$, —C$_{1-6}$alkyl-N(R$^{10}$)$_2$, C$_{2-6}$alkenyl, C$_{2-6}$alkynyl, C$_{1-6}$haloalkyl, C$_{3-8}$cycloalkyl, and —C$_{1-6}$alkyl-C$_{3-8}$cycloalkyl;

each R$^9$ is independently selected from C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, C$_{2-9}$heterocycloalkyl, —C$_{1-6}$alkyl-C$_{2-9}$heterocycloalkyl, C$_{2-9}$heteroaryl, and —C$_{1-6}$alkyl-C$_{2-9}$heteroaryl, wherein C$_{1-6}$alkyl, phenyl, —C$_{1-6}$alkyl-phenyl, —C$_{1-6}$alkyl-C$_{2-9}$heterocycloalkyl, C$_{2-9}$heteroaryl, and —C$_{1-6}$alkyl-C$_{2-9}$heteroaryl are optionally substituted with one or two groups independently selected from C$_{1-6}$alkyl, —OR$^{11}$, —N(R$^{11}$)$_2$, C$_{1-6}$alkyl, C$_{3-8}$cycloalkyl, —C(O)R$^{12}$, and —C(O)OR$^{12}$;

each R$^{10}$ is independently selected from H, C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, and C$_{2-9}$heteroaryl, wherein C$_{1-6}$alkyl, phenyl, —C$_{1-6}$alkyl-phenyl, and C$_{2-9}$heteroaryl are optionally substituted with one or two groups independently selected from halogen, C$_{1-6}$alkyl, and —N(R$^{11}$)$_2$; or two R$^{10}$ and the nitrogen atom to which they are attached are combined to form a 5- or 6-membered heterocycloalkyl ring optionally substituted with one, two, or three groups independently selected from C$_{1-6}$alkyl, oxo, and —C(O)OH;

each R$^{11}$ is independently selected from H and C$_{1-6}$alkyl;
each R$^{12}$ is independently selected from H and C$_{1-6}$alkyl; and
p is 0, 1, 2, 3, or 4;
or a pharmaceutically acceptable salt or solvate thereof.

In some instances, the small molecule that binds GPR35 is a compound of Formula (X):

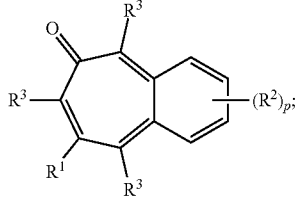

Formula (X)

wherein:
R$^1$ is selected from —C(O)OH, —C(O)OR$^{10}$,

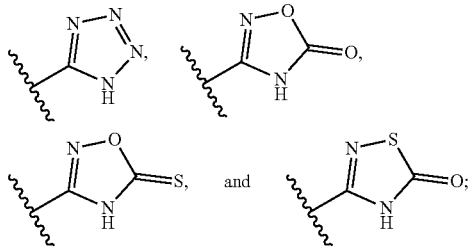

each R$^2$ is independently selected from halogen, —CN, —OH, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C(O)N(R$^{10}$)$_2$, —NR$^{10}$C(O)R$^9$, —NR$^{10}$C(O)OR$^9$, $C_{1-6}$alkyl, —$C_{1-6}$alkyl-OH, —$C_{1-6}$alkyl-OR$^9$, —$C_{1-6}$alkyl-N(R$^{10}$)$_2$, $C_{2-6}$alkenyl, $C_{2-6}$alkynyl, $C_{1-6}$haloalkyl, $C_{3-8}$cycloalkyl, and —$C_{1-6}$alkyl-$C_{3-8}$cycloalkyl;

each R$^3$ is independently selected from H, halogen, —CN, —OH, NO$_2$, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C(O)N(R$^{10}$)$_2$, —NR$^{10}$C(O)R$^9$, —NR$^{10}$C(O)OR$^9$, $C_{1-6}$alkyl, —$C_{1-6}$alkyl-OH, —$C_{1-6}$alkyl-OR$^9$, —$C_{1-6}$alkyl-N(R$^{10}$)$_2$, $C_{2-6}$alkenyl, $C_{2-6}$alkynyl, $C_{1-6}$haloalkyl, $C_{3-8}$cycloalkyl, and —$C_{1-6}$alkyl-$C_{3-8}$cycloalkyl;

each R$^9$ is independently selected from $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, and —$C_{1-6}$alkyl-$C_{2-9}$heteroaryl, wherein $C_{1-6}$alkyl, phenyl, —$C_{1-6}$alkyl-phenyl, —$C_{1-6}$alkyl-$C_{2-9}$heterocycloalkyl, $C_{2-9}$heteroaryl, and —$C_{1-6}$alkyl-$C_{2-9}$heteroaryl are optionally substituted with one or two groups independently selected from $C_{1-6}$alkyl, —OR$^{11}$, —N(R$^{11}$)$_2$, $C_{1-6}$alkyl, $C_{3-8}$cycloalkyl, —C(O)R$^{12}$, and —C(O)OR$^{12}$;

each R$^{10}$ is independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl, wherein $C_{1-6}$alkyl, phenyl, —$C_{1-6}$alkyl-phenyl, and $C_{2-9}$heteroaryl are optionally substituted with one or two groups independently selected from halogen, $C_{1-6}$alkyl, and —N(R$^{11}$)$_2$; or two R$^{10}$ and the nitrogen atom to which they are attached are combined to form a 5- or 6-membered heterocycloalkyl ring optionally substituted with one, two, or three groups independently selected from $C_{1-6}$alkyl, oxo, and —C(O)OH;

each R$^{11}$ is independently selected from H and $C_{1-6}$alkyl;
each R$^{12}$ is independently selected from H and $C_{1-6}$alkyl; and p is 0, 1, 2, 3, or 4;
or a pharmaceutically acceptable salt or solvate thereof.

In some instances, the small molecule that binds GPR35 is a compound of Formula (XI):

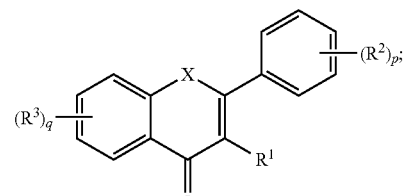

Formula (XI)

wherein:
X is selected from —O—, —S—, and —SO$_2$—;
R$^1$ is selected from H, halogen, —CN, —OH, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C(O)N(R$^{10}$)$_2$, —NR$^{10}$C(O)R$^9$, —NR$^{10}$C(O)OR$^9$, $C_{1-6}$alkyl, —$C_{1-6}$alkyl-OH, —$C_{1-6}$alkyl-OR$^9$, —$C_{1-6}$alkyl-N(R$^{10}$)$_2$, $C_{2-6}$alkenyl, $C_{2-6}$alkynyl, $C_{1-6}$haloalkyl, $C_{3-8}$cycloalkyl, and —$C_{1-6}$alkyl-$C_{3-8}$cycloalkyl;

each R$^2$ and each R$^3$ is independently selected from halogen, —CN, —OH, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C(O)N(R$^{10}$)$_2$, —NR$^{10}$C(O)R$^9$, —NR$^{10}$C(O)OR$^9$, $C_{1-6}$alkyl, —$C_{1-6}$alkyl-OH, —$C_{1-6}$alkyl-OR$^9$, —$C_{1-6}$alkyl-N(R$^{10}$)$_2$, $C_{2-6}$alkenyl, $C_{2-6}$alkynyl, $C_{1-6}$haloalkyl, $C_{3-8}$cycloalkyl, and —$C_{1-6}$alkyl-$C_{3-8}$cycloalkyl;

each R$^9$ is independently selected from $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, and —$C_{1-6}$alkyl-$C_{2-9}$heteroaryl, wherein $C_{1-6}$alkyl, phenyl, —$C_{1-6}$alkyl-phenyl, —$C_{1-6}$alkyl-$C_{2-9}$heterocycloalkyl, $C_{2-9}$heteroaryl, and —$C_{1-6}$alkyl-$C_{2-9}$heteroaryl are optionally substituted with one or two groups independently selected from $C_{1-6}$alkyl, —OR$^{11}$, —N(R$^{11}$)$_2$, $C_{1-6}$alkyl, $C_{3-8}$cycloalkyl, —C(O)R$^{12}$, and —C(O)OR$^{12}$;

each R$^{10}$ is independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl, wherein $C_{1-6}$alkyl, phenyl, —$C_{1-6}$alkyl-phenyl, and $C_{2-9}$heteroaryl are optionally substituted with one or two groups independently selected from halogen, $C_{1-6}$alkyl, and —N(R$^{11}$)$_2$; or two R$^{10}$ and the nitrogen atom to which they are attached are combined to form a 5- or 6-membered heterocycloalkyl ring optionally substituted with one, two, or three groups independently selected from $C_{1-6}$alkyl, oxo, and —C(O)OH;

each R$^{11}$ is independently selected from H and $C_{1-6}$alkyl;
each R$^{12}$ is independently selected from H and $C_{1-6}$alkyl;
p is 0, 1, 2, 3, or 4; and
q is 0, 1, 2, 3, or 4;
or a pharmaceutically acceptable salt or solvate thereof.

In some instances, the small molecule that binds GPR35 is a compound of Formula (XII):

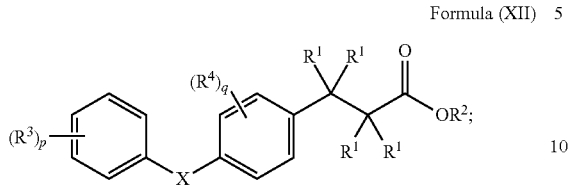

Formula (XII)

wherein:

X is selected from —O—, —S—, —NR$^{13}$—, and —C(R$^{14}$)$_2$—;

each R$^1$ is independently selected from H, halogen, —CN, —OH, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, C$_{1-6}$alkyl, —C$_{1-6}$alkyl-OH, —C$_{1-6}$alkyl-OR$^9$, —C$_{1-6}$alkyl-N(R$^{10}$)$_2$, C$_{2-6}$alkenyl, C$_{2-6}$alkynyl, C$_{1-6}$haloalkyl, C$_{3-8}$cycloalkyl, and —C$_{1-6}$alkyl-C$_{3-8}$cycloalkyl;

R$^2$ is selected from H and C$_{1-6}$alkyl;

each R$^3$ and each R$^4$ is independently selected from halogen, —CN, —OH, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C(O)N(R$^{10}$)$_2$, —NR$^{10}$C(O)R$^9$, —NR$^{10}$C(O)OR$^9$, C$_{1-6}$alkyl, —C$_{1-6}$alkyl-OH, —C$_{1-6}$alkyl-OR$^9$, —C$_{1-6}$alkyl-N(R$^{10}$)$_2$, C$_{2-6}$alkenyl, C$_{2-6}$alkynyl, C$_{1-6}$haloalkyl, C$_{3-8}$cycloalkyl, and —C$_{1-6}$alkyl-C$_{3-8}$cycloalkyl;

each R$^9$ is independently selected from C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, C$_{2-9}$heterocycloalkyl, —C$_{1-6}$alkyl-C$_{2-9}$heterocycloalkyl, C$_{2-9}$heteroaryl, and —C$_{1-6}$alkyl-C$_{2-9}$heteroaryl, wherein C$_{1-6}$alkyl, phenyl, —C$_{1-6}$alkyl-phenyl, —C$_{1-6}$alkyl-C$_{2-9}$heterocycloalkyl, C$_{2-9}$heteroaryl, and —C$_{1-6}$alkyl-C$_{2-9}$heteroaryl are optionally substituted with one or two groups independently selected from C$_{1-6}$alkyl, —OR$^{11}$, —N(R$^{11}$)$_2$, C$_{1-6}$alkyl, C$_{3-8}$cycloalkyl, —C(O)R$^{12}$, and —C(O)OR$^{12}$;

each R$^{10}$ is independently selected from H, C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, and C$_{2-9}$heteroaryl, wherein C$_{1-6}$alkyl, phenyl, —C$_{1-6}$alkyl-phenyl, and C$_{2-9}$heteroaryl are optionally substituted with one or two groups independently selected from halogen, C$_{1-6}$alkyl, and —N(R$^{11}$)$_2$; or two R$^{10}$ and the nitrogen atom to which they are attached are combined to form a 5- or 6-membered heterocycloalkyl ring optionally substituted with one, two, or three groups independently selected from C$_{1-6}$alkyl, oxo, and —C(O)OH;

each R$^{11}$ is independently selected from H and C$_{1-6}$alkyl;

each R$^{12}$ is independently selected from H and C$_{1-6}$alkyl;

R$^{13}$ is selected from H, C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, and C$_{2-9}$heteroaryl;

R$^{14}$ is selected from H, C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, C$_{2-9}$heterocycloalkyl, —C$_{1-6}$alkyl-C$_{2-9}$heterocycloalkyl, C$_{2-9}$heteroaryl, and —C$_{1-6}$alkyl-C$_{2-9}$heteroaryl;

p is 0, 1, 2, 3, or 4; and q is 0, 1, 2, 3, or 4;

or a pharmaceutically acceptable salt or solvate thereof.

In some instances, the small molecule that binds GPR35 is a compound of Formula (XIII):

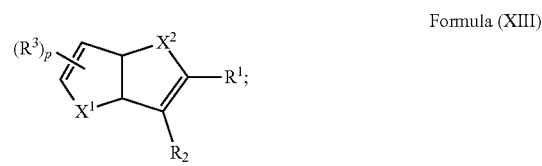

Formula (XIII)

wherein:

X$^1$ and X$^2$ are independently —O—, —S—, or —NR$^{13}$—;

R$^1$ is selected from —C(O)OH, —C(O)OR$^{10}$,

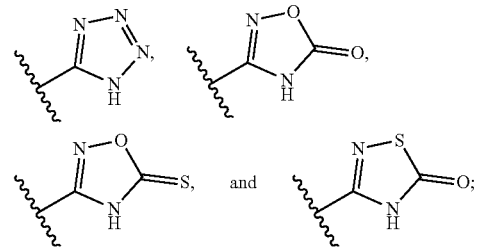

R$^2$ is selected from H, halogen, —CN, —OH, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C(O)N(R$^{10}$)$_2$, —NR$^{10}$C(O)R$^9$, —NR$^{10}$C(O)OR$^9$, C$_{1-6}$alkyl, —C$_{1-6}$alkyl-OH, —C$_{1-6}$alkyl-OR$^9$, —C$_{1-6}$alkyl-N(R$^{10}$)$_2$, C$_{2-6}$alkenyl, C$_{2-6}$alkynyl, C$_{1-6}$haloalkyl, C$_{3-8}$cycloalkyl, and —C$_{1-6}$alkyl-C$_{3-8}$cycloalkyl;

each R$^3$ is independently selected from halogen, —CN, —OH, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C(O)N(R$^{10}$)$_2$, —NR$^{10}$C(O)R$^9$, —NR$^{10}$C(O)OR$^9$, C$_{1-6}$alkyl, —C$_{1-6}$alkyl-OH, —C$_{1-6}$alkyl-OR$^9$, —C$_{1-6}$alkyl-N(R$^{10}$)$_2$, C$_{2-6}$alkenyl, C$_{2-6}$alkynyl, C$_{1-6}$haloalkyl, C$_{3-8}$cycloalkyl, and —C$_{1-6}$alkyl-C$_{3-8}$cycloalkyl;

each R$^9$ is independently selected from C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, C$_{2-9}$heterocycloalkyl, —C$_{1-6}$alkyl-C$_{2-9}$heterocycloalkyl, C$_{2-9}$heteroaryl, and —C$_{1-6}$alkyl-C$_{2-9}$heteroaryl, wherein C$_{1-6}$alkyl, phenyl, —C$_{1-6}$alkyl-phenyl, —C$_{1-6}$alkyl-C$_{2-9}$heterocycloalkyl, C$_{2-9}$heteroaryl, and —C$_{1-6}$alkyl-C$_{2-9}$heteroaryl are optionally substituted with one or two groups independently selected from C$_{1-6}$alkyl, —OR$^{11}$, —N(R$^{11}$)$_2$, C$_{1-6}$alkyl, C$_{3-8}$cycloalkyl, —C(O)R$^{12}$, and —C(O)OR$^{12}$;

each R$^{10}$ is independently selected from H, C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, and C$_{2-9}$heteroaryl, wherein C$_{1-6}$alkyl, phenyl, —C$_{1-6}$alkyl-phenyl, and C$_{2-9}$heteroaryl are optionally substituted with one or two groups independently selected from halogen, C$_{1-6}$alkyl, and —N(R$^{11}$)$_2$; or two R$^{10}$ and the nitrogen atom to which they are attached are combined to form a 5- or 6-membered heterocycloalkyl ring optionally substituted with one, two, or three groups independently selected from C$_{1-6}$alkyl, oxo, and —C(O)OH;
each R$^{11}$ is independently selected from H and C$_{1-6}$alkyl;
each R$^{12}$ is independently selected from H and C$_{1-6}$alkyl;
R$^{13}$ is selected from H, C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, and C$_{2-9}$heteroaryl; and
p is 0, 1 or 2;
or a pharmaceutically acceptable salt or solvate thereof.
In some instances, the small molecule that binds GPR35 is a compound of Formula (XIV):

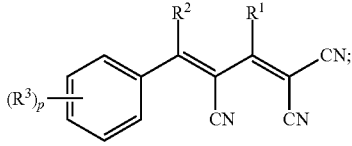

Formula (XIV)

wherein:
R$^1$ and R$^2$ are independently selected from H, halogen, —CN, —OH, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C(O)N(R$^{10}$)$_2$, —NR$^{10}$C(O)R$^9$, —NR$^{10}$C(O)OR$^9$, C$_{1-6}$alkyl, —C$_{1-6}$alkyl-OH, —C$_{1-6}$alkyl-OR$^9$, —C$_{1-6}$alkyl-N(R$^{10}$)$_2$, C$_{2-6}$alkenyl, C$_{2-6}$alkynyl, C$_{1-6}$haloalkyl, C$_{3-8}$cycloalkyl, and —C$_{1-6}$alkyl-C$_{3-8}$cycloalkyl;
each R$^3$ is independently selected from halogen, —CN, —OH, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C(O)N(R$^{10}$)$_2$, —NR$^{10}$C(O)R$^9$, —NR$^{10}$C(O)OR$^9$, C$_{1-6}$alkyl, —C$_{1-6}$alkyl-OH, —C$_{1-6}$alkyl-OR$^9$, —C$_{1-6}$alkyl-N(R$^{10}$)$_2$, C$_{2-6}$alkenyl, C$_{2-6}$alkynyl, C$_{1-6}$haloalkyl, C$_{3-8}$cycloalkyl, and —C$_{1-6}$alkyl-C$_{3-8}$cycloalkyl;
each R$^9$ is independently selected from C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, C$_{2-9}$heterocycloalkyl, —C$_{1-6}$alkyl-C$_{2-9}$heterocycloalkyl, C$_{2-9}$heteroaryl, and —C$_{1-6}$alkyl-C$_{2-9}$heteroaryl, wherein C$_{1-6}$alkyl, phenyl, —C$_{1-6}$alkyl-phenyl, —C$_{1-6}$alkyl-C$_{2-9}$heterocycloalkyl, C$_{2-9}$heteroaryl, and —C$_{1-6}$alkyl-C$_{2-9}$heteroaryl are optionally substituted with one or two groups independently selected from C$_{1-6}$alkyl, —OR$^{11}$, —N(R$^{11}$)$_2$, C$_{1-6}$alkyl, C$_{3-8}$cycloalkyl, —C(O)R$^{12}$, and —C(O)OR$^{12}$;
each R$^{10}$ is independently selected from H, C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, and C$_{2-9}$heteroaryl, wherein C$_{1-6}$alkyl, phenyl, —C$_{1-6}$alkyl-phenyl, and C$_{2-9}$heteroaryl are optionally substituted with one or two groups independently selected from halogen, C$_{1-6}$alkyl, and —N(R$^{11}$)$_2$; or two R$^{10}$ and the nitrogen atom to which they are attached are combined to form a 5- or 6-membered heterocycloalkyl ring optionally substituted with one, two, or three groups independently selected from C$_{1-6}$alkyl, oxo, and —C(O)OH;
each R$^{11}$ is independently selected from H and C$_{1-6}$alkyl;
each R$^{12}$ is independently selected from H and C$_{1-6}$alkyl; and
p is 0, 1, 2, 3, or 4;
or a pharmaceutically acceptable salt or solvate thereof.
In some instances, the small molecule that binds GPR35 is a compound of Formula (XV):

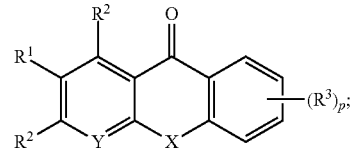

Formula (XV)

wherein:
X is selected from —O—, —S—, and —SO$_2$—;
Y is N or CR$^2$;
R$^1$ is —C(O)OH, —C(O)OR$^{10}$,

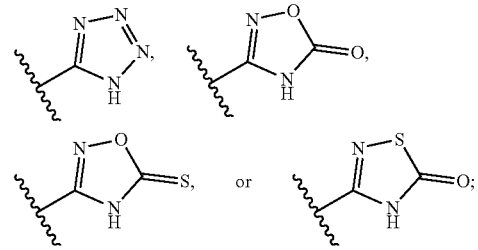

each R$^2$ is independently selected from H, halogen, —CN, —OH, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C(O)N(R$^{10}$)$_2$, —NR$^{10}$C(O)R$^9$, —NR$^{10}$C(O)OR$^9$, C$_{1-6}$alkyl, —C$_{1-6}$alkyl-OH, —C$_{1-6}$alkyl-OR$^9$, —C$_{1-6}$alkyl-N(R$^{10}$)$_2$, C$_{2-6}$alkenyl, C$_{2-6}$alkynyl, C$_{1-6}$haloalkyl, C$_{3-8}$cycloalkyl, and —C$_{1-6}$alkyl-C$_{3-8}$cycloalkyl;
each R$^3$ is independently selected from halogen, —CN, —OH, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C(O)N(R$^{10}$)$_2$, —NR$^{10}$C(O)R$^9$, —NR$^{10}$C(O)OR$^9$, C$_{1-6}$alkyl, —C$_{1-6}$alkyl-OH, —C$_{1-6}$alkyl-OR$^9$, —C$_{1-6}$alkyl-N(R$^{10}$)$_2$, C$_{2-6}$alkenyl, C$_{2-6}$alkynyl, C$_{1-6}$haloalkyl, C$_{3-8}$cycloalkyl, and —C$_{1-6}$alkyl-C$_{3-8}$cycloalkyl;
each R$^9$ is independently selected from C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, C$_{2-9}$heterocycloalkyl, —C$_{1-6}$alkyl-C$_{2-9}$heterocycloalkyl, C$_{2-9}$heteroaryl, and —C$_{1-6}$alkyl-C$_{2-9}$heteroaryl, wherein C$_{1-6}$alkyl, phenyl, —C$_{1-6}$alkyl-phenyl, —C$_{1-6}$alkyl-C$_{2-9}$heterocycloalkyl, C$_{2-9}$heteroaryl, and —C$_{1-6}$alkyl-C$_{2-9}$heteroaryl are optionally substituted with one or two groups independently selected from C$_{1-6}$alkyl, —OR$^{11}$, —N(R$^{11}$)$_2$, C$_{1-6}$alkyl, C$_{3-8}$cycloalkyl, —C(O)R$^{12}$, and —C(O)OR$^{12}$;

each $R^{10}$ is independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl, wherein $C_{1-6}$alkyl, phenyl, —$C_{1-6}$alkyl-phenyl, and $C_{2-9}$heteroaryl are optionally substituted with one or two groups independently selected from halogen, $C_{1-6}$alkyl, and —$N(R^{11})_2$; or two $R^{10}$ and the nitrogen atom to which they are attached are combined to form a 5- or 6-membered heterocycloalkyl ring optionally substituted with one, two, or three groups independently selected from $C_{1-6}$alkyl, oxo, and —C(O)OH;

each $R^{11}$ is independently selected from H and $C_{1-6}$alkyl;
each $R^{12}$ is independently selected from H and $C_{1-6}$alkyl; and
p is 0, 1, 2, 3, or 4;
or a pharmaceutically acceptable salt or solvate thereof.

In some instances, the small molecule that binds GPR35 is a compound of Formula (XVI):

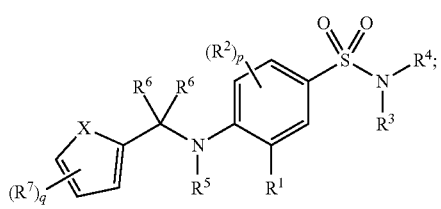

Formula (XVI)

wherein:
X is selected from —O—, —S—, and —$NR^{13}$—;
$R^1$ is selected from —C(O)OH, —C(O)O$R^{10}$,

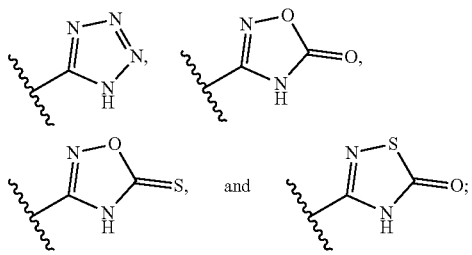

each $R^2$ and each $R^7$ is independently selected from halogen, —CN, —OH, —O$R^9$, —S$R^9$, —N($R^{10}$)$_2$, —S(O)$R^9$, —S(O)$_2R^9$, —NHS(O)$_2R^9$, —S(O)$_2$N($R^{10}$)$_2$, —C(O)$R^9$, —C(O)O$R^{10}$, —OC(O)$R^9$, —C(O)N($R^{10}$)$_2$, —OC(O)N($R^{10}$)$_2$, —N$R^{10}$C(O)N($R^{10}$)$_2$, —N$R^{10}$C(O)$R^9$, —N$R^{10}$C(O)O$R^9$, $C_{1-6}$alkyl, —$C_{1-6}$alkyl-OH, —$C_{1-6}$alkyl-O$R^9$, —$C_{1-6}$alkyl-N($R^{10}$)$_2$, $C_{2-6}$alkenyl, $C_{2-6}$alkynyl, $C_{1-6}$haloalkyl, $C_{3-8}$cycloalkyl, and —$C_{1-6}$alkyl-$C_{3-8}$cycloalkyl;

$R^3$ and $R^4$ are independently selected from H and $C_{1-6}$alkyl;
$R^5$ is selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl;
$R^6$ is independently H, halogen, —CN, —OH, —O$R^9$, —S$R^9$, —N($R^{10}$)$_2$, —S(O)$R^9$, —S(O)$_2R^9$, —NHS(O)$_2R^9$, —S(O)$_2$N($R^{10}$)$_2$, —C(O)$R^9$, —C(O)O$R^{10}$, —OC(O)$R^9$, —C(O)N($R^{10}$)$_2$, —OC(O)N($R^{10}$)$_2$, —N$R^{10}$C(O)N($R^{10}$)$_2$, —N$R^{10}$C(O)$R^9$, —N$R^{10}$C(O)O$R^9$, $C_{1-6}$alkyl, —$C_{1-6}$alkyl-OH, —$C_{1-6}$alkyl-O$R^9$, —$C_{1-6}$alkyl-N($R^{10}$)$_2$, $C_{2-6}$alkenyl, $C_{2-6}$alkynyl, $C_{1-6}$haloalkyl, $C_{3-8}$cycloalkyl, and —$C_{1-6}$alkyl-$C_{3-8}$cycloalkyl;

each $R^9$ is independently selected from $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, and —$C_{1-6}$alkyl-$C_{2-9}$heteroaryl, wherein $C_{1-6}$alkyl, phenyl, —$C_{1-6}$alkyl-phenyl, —$C_{1-6}$alkyl-$C_{2-9}$heterocycloalkyl, $C_{2-9}$heteroaryl, and —$C_{1-6}$alkyl-$C_{2-9}$heteroaryl are optionally substituted with one or two groups independently selected from $C_{1-6}$alkyl, —O$R^{11}$, —N($R^{11}$)$_2$, $C_{1-6}$alkyl, $C_{3-8}$cycloalkyl, —C(O)$R^{12}$, and —C(O)O$R^{12}$;

each $R^{10}$ is independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl, wherein $C_{1-6}$alkyl, phenyl, —$C_{1-6}$alkyl-phenyl, and $C_{2-9}$heteroaryl are optionally substituted with one or two groups independently selected from halogen, $C_{1-6}$alkyl, and —$N(R^{11})_2$; or two $R^{10}$ and the nitrogen atom to which they are attached are combined to form a 5- or 6-membered heterocycloalkyl ring optionally substituted with one, two, or three groups independently selected from $C_{1-6}$alkyl, oxo, and —C(O)OH;

each $R^{11}$ is independently selected from H and $C_{1-6}$alkyl;
each $R^{12}$ is independently selected from H and $C_{1-6}$alkyl;
$R^{13}$ is selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl;
p is 0, 1, 2, or 3; and
q is 0, 1, 2, or 3;
or a pharmaceutically acceptable salt or solvate thereof.

In some instances, the small molecule that binds GPR35 is a compound of Formula (XVII):

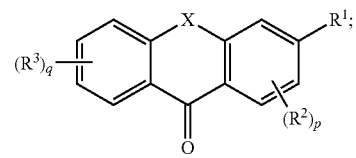

Formula (XVII)

wherein:
X is selected from —O—, —S—, and —$SO_2$—;
$R^1$ is selected from —C(O)OH, —C(O)O$R^{10}$,

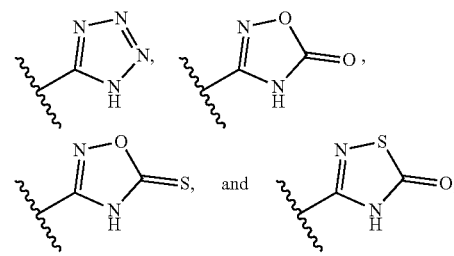

each $R^2$ and each $R^3$ is independently selected from halogen, —CN, —OH, —O$R^9$, —S$R^9$, —N($R^{10}$)$_2$, —S(O)$R^9$, —S(O)$_2R^9$, —NHS(O)$_2R^9$, —S(O)$_2$N($R^{10}$)$_2$, —C(O)$R^9$, —C(O)O$R^{10}$, —OC(O)$R^9$, —C(O)N($R^{10}$)$_2$, —OC(O)N($R^{10}$)$_2$, —N$R^{10}$C(O)N($R^{10}$)$_2$, —NR$^{10}$C(O)R$^9$, —NR$^{10}$C(O)OR$^9$, C$_{1-6}$ alkyl, —C$_{1-6}$alkyl-OH, —C$_{1-6}$alkyl-OR$^9$, —C$_{1-6}$alkyl-N(R$^{10}$)$_2$, C$_{2-6}$alkenyl, C$_{2-6}$alkynyl, C$_{1-6}$haloalkyl, C$_{3-8}$cycloalkyl, and —C$_{1-6}$alkyl-C$_{3-8}$cycloalkyl;

each R$^9$ is independently selected from C$_{1-6}$alkyl, C$_{1-6}$haloalkyl, C$_{3-8}$cycloalkyl, C$_{3-8}$ cycloalkyl, phenyl, —C$_{1-6}$alkyl-phenyl, C$_{2-9}$heterocycloalkyl, —C$_{1-6}$alkyl-C$_{2-9}$heterocycloalkyl, C$_{2-9}$heteroaryl, and —C$_{1-6}$alkyl-C$_{2-9}$heteroaryl, wherein C$_{1-6}$alkyl, phenyl, —C$_{1-6}$alkyl-phenyl, —C$_{1-6}$alkyl-C$_{2-9}$heterocycloalkyl, C$_{2-9}$heteroaryl, and —C$_{1-6}$alkyl-C$_{2-9}$heteroaryl are optionally substituted with one or two groups independently selected from C$_{1-6}$alkyl, —OR$^{11}$, —N(R$^{11}$)$_2$, C$_{1-6}$alkyl, C$_{3-8}$cycloalkyl, —C(O)R$^{12}$, and —C(O)OR$^{12}$;

each R$^{10}$ is independently selected from H, C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, and C$_{2-9}$heteroaryl, wherein C$_{1-6}$alkyl, phenyl, —C$_{1-6}$alkyl-phenyl, and C$_{2-9}$heteroaryl are optionally substituted with one or two groups independently selected from halogen, C$_{1-6}$alkyl, and —N(R$^{11}$)$_2$; or two R$^{10}$ and the nitrogen atom to which they are attached are combined to form a 5- or 6-membered heterocycloalkyl ring optionally substituted with one, two, or three groups independently selected from C$_{1-6}$alkyl, oxo, and —C(O)OH;

each R$^{11}$ is independently selected from H and C$_{1-6}$alkyl;
each R$^{12}$ is independently selected from H and C$_{1-6}$alkyl;
p is 0, 1, 2, or 3; and
q is 0, 1, 2, 3, or 4;
or a pharmaceutically acceptable salt or solvate thereof.

In some instances, the small molecule that binds GPR35 is a compound of Formula (XVIII):

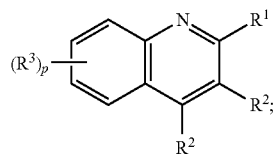

Formula (XVIII)

wherein:
R$^1$ is selected from —C(O)OH, —C(O)OR$^{10}$,

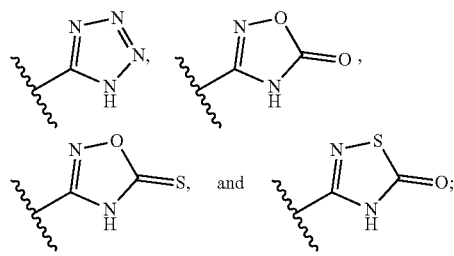

R$^2$ is independently selected from H, halogen, —CN, —OH, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C(O)N(R$^{10}$)$_2$, —NR$^{10}$C(O)R$^9$, —NR$^{10}$C(O)OR$^9$, C$_{1-6}$alkyl, —C$_{1-6}$alkyl-OH, —C$_{1-6}$alkyl-OR$^9$, —C$_{1-6}$alkyl-N(R$^{10}$)$_2$, C$_{2-6}$alkenyl, C$_{2-6}$alkynyl, C$_{1-6}$haloalkyl, C$_{3-8}$cycloalkyl, and —C$_{1-6}$alkyl-C$_{3-8}$cycloalkyl;

each R$^3$ is independently selected from halogen, —CN, —OH, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C(O)N(R$^{10}$)$_2$, —NR$^{10}$C(O)R$^9$, —NR$^{10}$C(O)OR$^9$, C$_{1-6}$alkyl, —C$_{1-6}$alkyl-OH, —C$_{1-6}$alkyl-OR$^9$, —C$_{1-6}$alkyl-N(R$^{10}$)$_2$, C$_{2-6}$alkenyl, C$_{2-6}$alkynyl, C$_{1-6}$haloalkyl, C$_{3-8}$cycloalkyl, and —C$_{1-6}$alkyl-C$_{3-8}$cycloalkyl;

each R$^9$ is independently selected from C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, C$_{2-9}$heterocycloalkyl, —C$_{1-6}$alkyl-C$_{2-9}$heterocycloalkyl, C$_{2-9}$heteroaryl, and —C$_{1-6}$alkyl-C$_{2-9}$heteroaryl, wherein C$_{1-6}$alkyl, phenyl, —C$_{1-6}$alkyl-phenyl, —C$_{1-6}$alkyl-C$_{2-9}$heterocycloalkyl, C$_{2-9}$heteroaryl, and —C$_{1-6}$alkyl-C$_{2-9}$heteroaryl are optionally substituted with one or two groups independently selected from C$_{1-6}$alkyl, —OR$^{11}$, —N(R$^{11}$)$_2$, C$_{1-6}$alkyl, C$_{3-8}$cycloalkyl, —C(O)R$^{12}$, and —C(O)OR$^{12}$;

each R$^{10}$ is independently selected from H, C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, and C$_{2-9}$heteroaryl, wherein C$_{1-6}$alkyl, phenyl, —C$_{1-6}$alkyl-phenyl, and C$_{2-9}$heteroaryl are optionally substituted with one or two groups independently selected from halogen, C$_{1-6}$alkyl, and —N(R$^{11}$)$_2$; or two R$^{10}$ and the nitrogen atom to which they are attached are combined to form a 5- or 6-membered heterocycloalkyl ring optionally substituted with one, two, or three groups independently selected from C$_{1-6}$alkyl, oxo, and —C(O)OH;

each R$^{11}$ is independently selected from H and C$_{1-6}$alkyl;
each R$^{12}$ is independently selected from H and C$_{1-6}$alkyl; and
p is 0, 1, 2, 3, or 4;
or a pharmaceutically acceptable salt or solvate thereof.

In some instances, the small molecule that binds GPR35 is a compound of Formula (XIX):

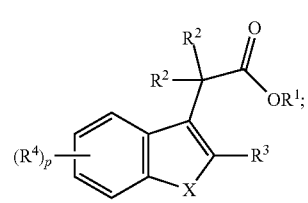

Formula (XIX)

wherein:
X is selected from —O—, —S—, and —NR$^{13}$—;
R$^1$ is selected from H and C$_{1-6}$alkyl;
R$^2$ is independently selected from H, halogen, —CN, —OH, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C(O)N(R$^{10}$)$_2$, —NR$^{10}$C(O)R$^9$, —NR$^{10}$C(O)OR$^9$, C$_{1-6}$alkyl, —C$_{1-6}$alkyl-OH, —C$_{1-6}$alkyl-OR$^9$, —C$_{1-6}$alkyl-N(R$^{10}$)$_2$, C$_{2-6}$alkenyl, C$_{2-6}$alkynyl, C$_{1-6}$haloalkyl, C$_{3-8}$cycloalkyl, and —C$_{1-6}$alkyl-C$_{3-8}$cycloalkyl;

R$^3$ is selected from H, halogen, —CN, —OH, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C (O)N(R$^{10}$)$_2$, —NR$^{10}$C(O)R$^9$, —NR$^{10}$C(O)OR$^9$, C$_{1-6}$alkyl, —C$_{1-6}$alkyl-OH, —C$_{1-6}$alkyl-OR$^9$, —C$_{1-6}$alkyl-N(R$^{10}$)$_2$, C$_{2-6}$alkenyl, C$_{2-6}$alkynyl, C$_{1-6}$haloalkyl, C$_{3-8}$cycloalkyl, and —C$_{1-6}$alkyl-C$_{3-8}$cycloalkyl;

each R$^4$ is independently selected from halogen, —CN, —OH, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C(O)N(R$^{10}$)$_2$, —NR$^{10}$C(O)R$^9$, —NR$^{10}$C(O)OR$^9$, C$_{1-6}$alkyl, —C$_{1-6}$alkyl-OH, —C$_{1-6}$alkyl-OR$^9$, —C$_{1-6}$alkyl-N(R$^{10}$)$_2$, C$_{2-6}$alkenyl, C$_{2-6}$alkynyl, C$_{1-6}$haloalkyl, C$_{3-8}$cycloalkyl, and —C$_{1-6}$alkyl-C$_{3-8}$cycloalkyl;

each R$^9$ is independently selected from C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, C$_{2-9}$heterocycloalkyl, —C$_{1-6}$alkyl-C$_{2-9}$heterocycloalkyl, C$_{2-9}$heteroaryl, and —C$_{1-6}$alkyl-C$_{2-9}$heteroaryl, wherein C$_{1-6}$alkyl, phenyl, —C$_{1-6}$alkyl-phenyl, —C$_{1-6}$alkyl-C$_{2-9}$heterocycloalkyl, C$_{2-9}$heteroaryl, and —C$_{1-6}$alkyl-C$_{2-9}$heteroaryl are optionally substituted with one or two groups independently selected from C$_{1-6}$alkyl, —OR$^{11}$, —N(R$^{11}$)$_2$, C$_{1-6}$alkyl, C$_{3-8}$cycloalkyl, —C(O)R$^{12}$, and —C(O)OR$^{12}$;

each R$^{10}$ is independently selected from H, C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, and C$_{2-9}$heteroaryl, wherein C$_{1-6}$alkyl, phenyl, —C$_{1-6}$alkyl-phenyl, and C$_{2-9}$heteroaryl are optionally substituted with one or two groups independently selected from halogen, C$_{1-6}$alkyl, and —N(R$^{11}$)$_2$; or two R$^{10}$ and the nitrogen atom to which they are attached are combined to form a 5- or 6-membered heterocycloalkyl ring optionally substituted with one, two, or three groups independently selected from C$_{1-6}$alkyl, oxo, and —C(O)OH;

each R$^{11}$ is independently selected from H and C$_{1-6}$alkyl;
each R$^{12}$ is independently selected from H and C$_{1-6}$alkyl;
R$^{13}$ is selected from H, C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, and C$_{2-9}$heteroaryl; and
p is 0, 1, 2, 3, or 4;
or a pharmaceutically acceptable salt or solvate thereof.

In some instances, the small molecule that binds GPR35 is a compound of Formula (XX):

Formula (XX)

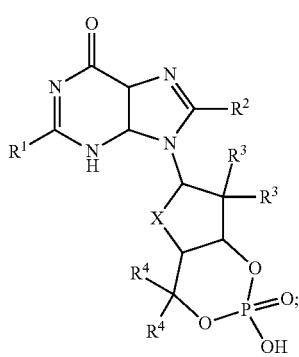

wherein:
X is selected from —O— and —C(R$^{14}$)$_2$—;
R$^1$ is selected from H, halogen, —CN, —OH, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C(O)N(R$^{10}$)$_2$, —NR$^{10}$C(O)R$^9$, —NR$^{10}$C(O)OR$^9$, C$_{1-6}$alkyl, —C$_{1-6}$alkyl-OH, —C$_{1-6}$alkyl-OR$^9$, —C$_{1-6}$alkyl-N(R$^{10}$)$_2$, C$_{2-6}$alkenyl, C$_{2-6}$alkynyl, C$_{1-6}$haloalkyl, C$_{3-8}$cycloalkyl, and —C$_{1-6}$alkyl-C$_{3-8}$cycloalkyl;

R$^2$ is selected from H, halogen, —CN, —OH, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C(O)N(R$^{10}$)$_2$, —NR$^{10}$C(O)R$^9$, —NR$^{10}$C(O)OR$^9$, C$_{1-6}$alkyl, —C$_{1-6}$alkyl-OH, —C$_{1-6}$alkyl-OR$^9$, —C$_{1-6}$alkyl-N(R$^{10}$)$_2$, C$_{2-6}$alkenyl, C$_{2-6}$alkynyl, C$_{1-6}$haloalkyl, C$_{3-8}$cycloalkyl, and —C$_{1-6}$alkyl-C$_{3-8}$cycloalkyl;

each R$^3$ and each R$^4$ is selected from H, halogen, —CN, —OH, —OR$^9$, —SR$^9$, —N(R$^{10}$)$_2$, —S(O)R$^9$, —S(O)$_2$R$^9$, —NHS(O)$_2$R$^9$, —S(O)$_2$N(R$^{10}$)$_2$, —C(O)R$^9$, —C(O)OR$^{10}$, —OC(O)R$^9$, —C(O)N(R$^{10}$)$_2$, —OC(O)N(R$^{10}$)$_2$, —NR$^{10}$C(O)N(R$^{10}$)$_2$, —NR$^{10}$C(O)R$^9$, —NR$^{10}$C(O)OR$^9$, C$_{1-6}$alkyl, —C$_{1-6}$alkyl-OH, —C$_{1-6}$alkyl-OR$^9$, —C$_{1-6}$alkyl-N(R$^{10}$)$_2$, C$_{2-6}$alkenyl, C$_{2-6}$alkynyl, C$_{1-6}$haloalkyl, C$_{3-8}$cycloalkyl, and —C$_{1-6}$alkyl-C$_{3-8}$cycloalkyl;

each R$^9$ is independently selected from C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, C$_{2-9}$heterocycloalkyl, —C$_{1-6}$alkyl-C$_{2-9}$heterocycloalkyl, C$_{2-9}$heteroaryl, and —C$_{1-6}$alkyl-C$_{2-9}$heteroaryl, wherein C$_{1-6}$alkyl, phenyl, —C$_{1-6}$alkyl-phenyl, —C$_{1-6}$alkyl-C$_{2-9}$heterocycloalkyl, C$_{2-9}$heteroaryl, and —C$_{1-6}$alkyl-C$_{2-9}$heteroaryl are optionally substituted with one or two groups independently selected from C$_{1-6}$alkyl, —OR$^{11}$, —N(R$^{11}$)$_2$, C$_{1-6}$alkyl, C$_{3-8}$cycloalkyl, —C(O)R$^{12}$, and —C(O)OR$^{12}$;

each R$^{10}$ is independently selected from H, C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, and C$_{2-9}$heteroaryl, wherein C$_{1-6}$alkyl, phenyl, —C$_{1-6}$alkyl-phenyl, and C$_{2-9}$heteroaryl are optionally substituted with one or two groups independently selected from halogen, C$_{1-6}$alkyl, and —N(R$^{11}$)$_2$; or two R$^{10}$ and the nitrogen atom to which they are attached are combined to form a 5- or 6-membered heterocycloalkyl ring optionally substituted with one, two, or three groups independently selected from C$_{1-6}$alkyl, oxo, and —C(O)OH;

each R$^{11}$ is independently selected from H and C$_{1-6}$alkyl;
each R$^{12}$ is independently selected from H and C$_{1-6}$alkyl;
each R$^{14}$ is independently selected from H, halogen, C$_{1-6}$alkyl, C$_{1-6}$haloalkyl, C$_{3-8}$cycloalkyl, —C$_{1-6}$alkyl-C$_{3-8}$cycloalkyl, phenyl, —C$_{1-6}$alkyl-phenyl, C$_{2-9}$heterocycloalkyl, —C$_{1-6}$alkyl-C$_{2-9}$heterocycloalkyl, C$_{2-9}$heteroaryl, and —C$_{1-6}$alkyl-C$_{2-9}$heteroaryl; and
or a pharmaceutically acceptable salt or solvate thereof.

In some instances, the small molecule that binds GPR35 is a compound of Formula (XXI):

Formula (XXI)

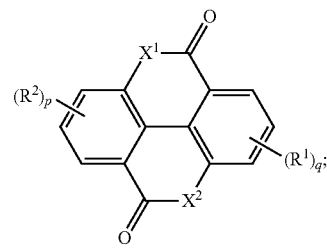

wherein:

$X^1$ and $X^2$ are independently selected from —O— and —S—;

each $R^1$ and each $R^2$ are independently selected from halogen, —CN, —OH, —$OR^9$, —$SR^9$, —$N(R^{10})_2$, —$S(O)R^9$, —$S(O)_2R^9$, —$NHS(O)_2R^9$, —$S(O)_2N(R^{10})_2$, —$C(O)R^9$, —$C(O)OR^{10}$, —$OC(O)R^9$, —$C(O)N(R^{10})_2$, —$OC(O)N(R^{10})_2$, —$NR^{10}C(O)N(R^{10})_2$, —$NR^{10}C(O)R^9$, —$NR^{10}C(O)OR^9$, $C_{1-6}$alkyl, —$C_{1-6}$alkyl-OH, —$C_{1-6}$alkyl-$OR^9$, —$C_{1-6}$alkyl-$N(R^{10})_2$, $C_{2-6}$alkenyl, $C_{2-6}$alkynyl, $C_{1-6}$haloalkyl, $C_{3-8}$cycloalkyl, and —$C_{1-6}$alkyl-$C_{3-8}$cycloalkyl;

each $R^9$ is independently selected from $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, and —$C_{1-6}$alkyl-$C_{2-9}$heteroaryl, wherein $C_{1-6}$alkyl, phenyl, —$C_{1-6}$alkyl-phenyl, —$C_{1-6}$alkyl-$C_{2-9}$heterocycloalkyl, $C_{2-9}$heteroaryl, and —$C_{1-6}$alkyl-$C_{2-9}$heteroaryl are optionally substituted with one or two groups independently selected from $C_{1-6}$alkyl, —$OR^{11}$, —$N(R^{11})_2$, $C_{1-6}$alkyl, $C_{3-8}$cycloalkyl, —$C(O)R^{12}$, and —$C(O)OR^{12}$;

each $R^{10}$ is independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl, wherein $C_{1-6}$alkyl, phenyl, —$C_{1-6}$alkyl-phenyl, and $C_{2-9}$heteroaryl are optionally substituted with one or two groups independently selected from halogen, $C_{1-6}$alkyl, and —$N(R^{11})_2$; or two $R^{10}$ and the nitrogen atom to which they are attached are combined to form a 5- or 6-membered heterocycloalkyl ring optionally substituted with one, two, or three groups independently selected from $C_{1-6}$alkyl, oxo, and —C(O)OH;

each $R^{11}$ is independently selected from H and $C_{1-6}$alkyl;

each $R^{12}$ is independently selected from H and $C_{1-6}$alkyl;

$R^{13}$ is selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl;

p is 0, 1, 2, or 3;

q is 0, 1, 2, or 3; and or a pharmaceutically acceptable salt or solvate thereof.

In some instances, the small molecule that binds GPR35 is a compound of Formula (XXII):

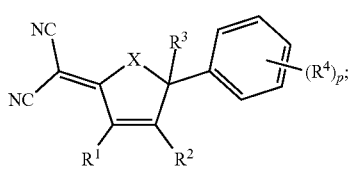

Formula (XXII)

wherein:

X is selected from —O— and —S—;

$R^1$, $R^2$, and $R^3$ are independently selected from H, halogen, —CN, —OH, —$OR^9$, —$SR^9$, —$N(R^{10})_2$, —$S(O)R^9$, —$S(O)_2R^9$, —$NHS(O)_2R^9$, —$S(O)_2N(R^{10})_2$, —$C(O)R^9$, —$C(O)OR^{10}$, —$OC(O)R^9$, —$C(O)N(R^{10})_2$, —$OC(O)N(R^{10})_2$, —$NR^{10}C(O)N(R^{10})_2$, —$NR^{10}C(O)R^9$, —$NR^{10}C(O)OR^9$, $C_{1-6}$alkyl, —$C_{1-6}$alkyl-OH, —$C_{1-6}$alkyl-$OR^9$, —$C_{1-6}$alkyl-$N(R^{10})_2$, $C_{2-6}$alkenyl, $C_{2-6}$alkynyl, $C_{1-6}$haloalkyl, $C_{3-8}$cycloalkyl, and —$C_{1-6}$alkyl-$C_{3-8}$cycloalkyl;

each $R^4$ is selected from halogen, —CN, —OH, —$OR^9$, —$SR^9$, —$N(R^{10})_2$, —$S(O)R^9$, —$S(O)_2R^9$, —$NHS(O)_2R^9$, —$S(O)_2N(R^{10})_2$, —$C(O)R^9$, —$C(O)OR^{10}$, —$OC(O)R^9$, —$C(O)N(R^{10})_2$, —$OC(O)N(R^{10})_2$, —$NR^{10}C(O)N(R^{10})_2$, —$NR^{10}C(O)R^9$, —$NR^{10}C(O)OR^9$, $C_{1-6}$alkyl, —$C_{1-6}$alkyl-OH, —$C_{1-6}$alkyl-$OR^9$, —$C_{1-6}$alkyl-$N(R^{10})_2$, $C_{2-6}$alkenyl, $C_{2-6}$alkynyl, $C_{1-6}$haloalkyl, $C_{3-8}$cycloalkyl, and —$C_{1-6}$alkyl-$C_{3-8}$cycloalkyl;

each $R^9$ is independently selected from $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, and —$C_{1-6}$alkyl-$C_{2-9}$heteroaryl, wherein $C_{1-6}$alkyl, phenyl, —$C_{1-6}$alkyl-phenyl, —$C_{1-6}$alkyl-$C_{2-9}$heterocycloalkyl, $C_{2-9}$heteroaryl, and —$C_{1-6}$alkyl-$C_{2-9}$heteroaryl are optionally substituted with one or two groups independently selected from $C_{1-6}$alkyl, —$OR^{11}$, —$N(R^{11})_2$, $C_{1-6}$alkyl, $C_{3-8}$cycloalkyl, —$C(O)R^{12}$, and —$C(O)OR^{12}$;

each $R^{10}$ is independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl, wherein $C_{1-6}$alkyl, phenyl, —$C_{1-6}$alkyl-phenyl, and $C_{2-9}$heteroaryl are optionally substituted with one or two groups independently selected from halogen, $C_{1-6}$alkyl, and —$N(R^{11})_2$; or two $R^{10}$ and the nitrogen atom to which they are attached are combined to form a 5- or 6-membered heterocycloalkyl ring optionally substituted with one, two, or three groups independently selected from $C_{1-6}$alkyl, oxo, and —C(O)OH;

each $R^{11}$ is independently selected from H and $C_{1-6}$alkyl;

each $R^{12}$ is independently selected from H and $C_{1-6}$alkyl; and p is 0, 1, 2, 3, or 4;

or a pharmaceutically acceptable salt or solvate thereof.

In some instances, the small molecule that binds GPR35 is a compound of Formula (XXIII):

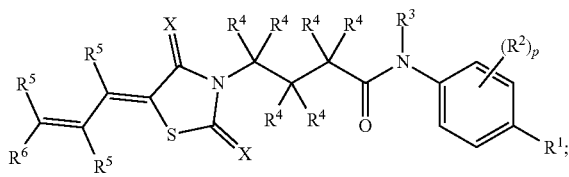

Formula (XXIII)

wherein:

each X is independently selected from —O— and —S—;

$R^1$ is selected from —C(O)OH, —$C(O)OR^{10}$,

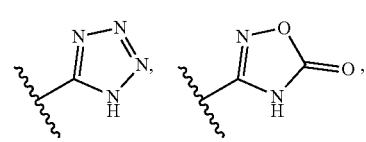

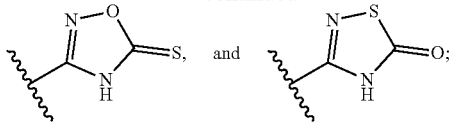 and each $R^2$ is selected from halogen, —CN, —OH, —$OR^9$, —$SR^9$, —$N(R^{10})_2$, —$S(O)R^9$, —$S(O)_2R^9$, —$NHS(O)_2R^9$, —$S(O)_2N(R^{10})_2$, —$C(O)R^9$, —$C(O)OR^{10}$, —$OC(O)R^9$, —$C(O)N(R^{10})_2$, —$OC(O)N(R^{10})_2$, —$NR^{10}C(O)N(R^{10})_2$, —$NR^{10}C(O)R^9$, —$NR^{10}C(O)OR^9$, $C_{1-6}$alkyl, —$C_{1-6}$alkyl-OH, —$C_{1-6}$alkyl-$OR^9$, —$C_{1-6}$alkyl-$N(R^{10})_2$, $C_{2-6}$alkenyl, $C_{2-6}$alkynyl, $C_{1-6}$haloalkyl, $C_{3-8}$cycloalkyl, and —$C_{1-6}$alkyl-$C_{3-8}$cycloalkyl;

$R^3$ is selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl;

each $R^4$ and each $R^5$ are independently selected from H, halogen, —CN, —OH, —$OR^9$, —$SR^9$, —$N(R^{10})_2$, —$S(O)R^9$, —$S(O)_2R^9$, —$NHS(O)_2R^9$, —$S(O)_2N(R^{10})_2$, —$C(O)R^9$, —$C(O)OR^{10}$, —$OC(O)R^9$, —$C(O)N(R^{10})_2$, —$OC(O)N(R^{10})_2$, —$NR^{10}C(O)N(R^{10})_2$, —$NR^{10}C(O)R^9$, —$NR^{10}C(O)OR^9$, $C_{1-6}$alkyl, —$C_{1-6}$alkyl-OH, —$C_{1-6}$alkyl-$OR^9$, —$C_{1-6}$alkyl-$N(R^{10})_2$, $C_{2-6}$alkenyl, $C_{2-6}$alkynyl, $C_{1-6}$haloalkyl, $C_{3-8}$cycloalkyl, and —$C_{1-6}$alkyl-$C_{3-8}$cycloalkyl;

$R^6$ is selected from $C_{3-8}$cycloalkyl, $C_{2-9}$heterocycloalkyl, $C_{2-9}$heteroaryl, and phenyl, wherein $C_{3-8}$cycloalkyl, $C_{2-9}$heterocycloalkyl, $C_{2-9}$heteroaryl, and phenyl are optionally substituted with one or two groups independently selected from $C_{1-6}$alkyl, —$OR^{11}$, —$N(R^{11})_2$, $C_{1-6}$alkyl, $C_{3-8}$cycloalkyl, —$C(O)R^{12}$, and —$C(O)OR^{12}$;

each $R^9$ is independently selected from $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, and —$C_{1-6}$alkyl-$C_{2-9}$heteroaryl, wherein $C_{1-6}$alkyl, phenyl, —$C_{1-6}$alkyl-phenyl, —$C_{1-6}$alkyl-$C_{2-9}$heterocycloalkyl, $C_{2-9}$heteroaryl, and —$C_{1-6}$alkyl-$C_{2-9}$heteroaryl are optionally substituted with one or two groups independently selected from $C_{1-6}$alkyl, —$OR^{11}$, —$N(R^{11})_2$, $C_{1-6}$alkyl, $C_{3-8}$cycloalkyl, —$C(O)R^{12}$, and —$C(O)OR^{12}$;

each $R^{10}$ is independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl, wherein $C_{1-6}$alkyl, phenyl, —$C_{1-6}$alkyl-phenyl, and $C_{2-9}$heteroaryl are optionally substituted with one or two groups independently selected from halogen, $C_{1-6}$alkyl, and —$N(R^{11})_2$; or two $R^{10}$ and the nitrogen atom to which they are attached are combined to form a 5- or 6-membered heterocycloalkyl ring optionally substituted with one, two, or three groups independently selected from $C_{1-6}$alkyl, oxo, and —C(O)OH;

each $R^{11}$ is independently selected from H and $C_{1-6}$alkyl;

each $R^{12}$ is independently selected from H and $C_{1-6}$alkyl; and p is 0, 1, 2, 3, or 4;

or a pharmaceutically acceptable salt or solvate thereof.

In some instances, the small molecule that binds GPR35 is a compound of Formula (XXIV):

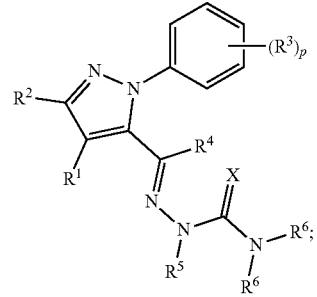

Formula (XXIV)

wherein:

X is selected from —O— and —S—;

$R^1$ is selected from —C(O)OH, —C(O)$OR^{10}$,

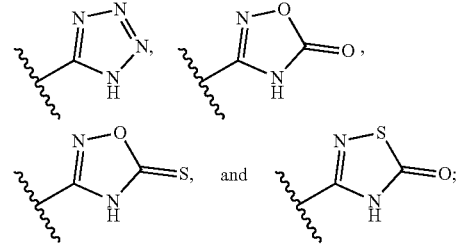

each $R^2$ is selected from H, halogen, —CN, —OH, —$OR^9$, —$SR^9$, —$N(R^{10})_2$, —$S(O)R^9$, —$S(O)_2R^9$, —$NHS(O)_2R^9$, —$S(O)_2N(R^{10})_2$, —$C(O)R^9$, —$C(O)OR^{10}$, —$OC(O)R^9$, —$C(O)N(R^{10})_2$, —$OC(O)N(R^{10})_2$, —$NR^{10}C(O)N(R^{10})_2$, —$NR^{10}C(O)R^9$, —$NR^{10}C(O)OR^9$, $C_{1-6}$alkyl, —$C_{1-6}$alkyl-OH, —$C_{1-6}$alkyl-$OR^9$, —$C_{1-6}$alkyl-$N(R^{10})_2$, $C_{2-6}$alkenyl, $C_{2-6}$alkynyl, $C_{1-6}$haloalkyl, $C_{3-8}$cycloalkyl, and —$C_{1-6}$alkyl-$C_{3-8}$cycloalkyl;

each $R^3$ is selected from halogen, —CN, —OH, —$OR^9$, —$SR^9$, —$N(R^{10})_2$, —$S(O)R^9$, —$S(O)_2R^9$, —$NHS(O)_2R^9$, —$S(O)_2N(R^{10})_2$, —$C(O)R^9$, —$C(O)OR^{10}$, —$OC(O)R^9$, —$C(O)N(R^{10})_2$, —$OC(O)N(R^{10})_2$, —$NR^{10}C(O)N(R^{10})_2$, —$NR^{10}C(O)R^9$, —$NR^{10}C(O)OR^9$, $C_{1-6}$alkyl, —$C_{1-6}$alkyl-OH, —$C_{1-6}$alkyl-$OR^9$, —$C_{1-6}$alkyl-$N(R^{10})_2$, $C_{2-6}$alkenyl, $C_{2-6}$alkynyl, $C_{1-6}$haloalkyl, $C_{3-8}$cycloalkyl, and —$C_{1-6}$alkyl-$C_{3-8}$cycloalkyl;

$R^4$ is selected from H, $C_{1-6}$alkyl, $C_{1-6}$haloalkyl, and $C_{3-8}$cycloalkyl;

$R^5$ is selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl;

$R^6$ is independently selected from H, $C_{1-6}$alkyl, $C_{1-6}$haloalkyl, $C_{3-8}$cycloalkyl, —$C_{1-6}$alkyl-$C_{3-8}$ cycloalkyl, phenyl, —$C_{1-6}$alkyl-phenyl, and $C_{2-9}$heteroaryl;

each $R^9$ is independently selected from $C_{1-6}$alkyl, $C_{1-6}$haloalkyl, $C_{3-8}$cycloalkyl, —$C_{1-6}$alkyl-$C_{3-8}$ cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, and —$C_{1-6}$alkyl-$C_{2-9}$heteroaryl, wherein $C_{1-6}$alkyl, phenyl, —$C_{1-6}$alkyl-phenyl, —$C_{1-6}$alkyl-$C_{2-9}$heterocycloalkyl, $C_{2-9}$heteroaryl, and —$C_{1-6}$alkyl-$C_{2-9}$heteroaryl are optionally substituted with one or two groups independently selected from $C_{1-6}$alkyl, —$OR^{11}$, —$N(R^{11})_2$, $C_{1-6}$alkyl, $C_{3-8}$cycloalkyl, —$C(O)R^{12}$, and —$C(O)OR^{12}$;

each $R^{10}$ is independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl, wherein $C_{1-6}$alkyl, phenyl, —$C_{1-6}$alkyl-phenyl, and $C_{2-9}$heteroaryl are optionally substituted with one or two groups independently selected from halogen, $C_{1-6}$alkyl, and —$N(R^{11})_2$; or two $R^{10}$ and the nitrogen atom to which they are attached are combined to form a 5- or 6-membered heterocycloalkyl ring optionally substituted with one, two, or three groups independently selected from $C_{1-6}$alkyl, oxo, and —$C(O)OH$;

each $R^{11}$ is independently selected from H and $C_{1-6}$alkyl;
each $R^{12}$ is independently selected from H and $C_{1-6}$alkyl; and
p is 0, 1, 2, 3, or 4;
or a pharmaceutically acceptable salt or solvate thereof.

In some instances, the small molecule that binds GPR35 is a compound of Formula (XXV):

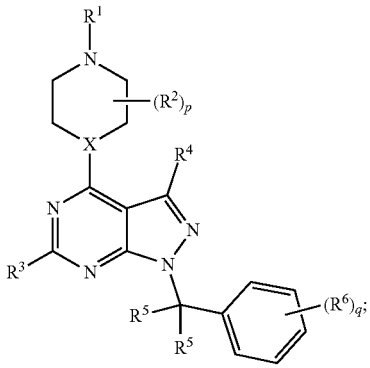

Formula (XXV)

wherein:

X is selected from $CR^2$ or N;

$R^1$ is selected from $C_{3-8}$cycloalkyl, $C_{2-9}$heterocycloalkyl, $C_{2-9}$heteroaryl, and phenyl, wherein $C_{3-8}$cycloalkyl, $C_{2-9}$heterocycloalkyl, $C_{2-9}$heteroaryl, and phenyl are optionally substituted with one or two groups independently selected from $C_{1-6}$alkyl, —$OR^{11}$, —$N(R^{11})_2$, $C_{1-6}$alkyl, $C_{3-8}$cycloalkyl, —$C(O)R^{12}$, and —$C(O)OR^{12}$;

each $R^2$ and each $R^6$ is selected from halogen, —CN, —OH, —$OR^9$, —$SR^9$, —$N(R^{10})_2$, —$S(O)R^9$, —$S(O)_2R^9$, —$NHS(O)_2R^9$, —$S(O)_2N(R^{10})_2$, —$C(O)R^9$, —$C(O)OR^{10}$, —$OC(O)R^9$, —$C(O)N(R^{10})_2$, —$OC(O)N(R^{10})_2$, —$NR^{10}C(O)N(R^{10})_2$, —$NR^{10}C(O)R^9$, —$NR^{10}C(O)OR^9$, $C_{1-6}$alkyl, —$C_{1-6}$alkyl-OH, —$C_{1-6}$alkyl-$OR^9$, —$C_{1-6}$alkyl-$N(R^{10})_2$, $C_{2-6}$alkenyl, $C_{2-6}$alkynyl, $C_{1-6}$haloalkyl, $C_{3-8}$cycloalkyl, and —$C_{1-6}$alkyl-$C_{3-8}$cycloalkyl;

$R^3$ and $R^4$ are independently selected from H, halogen, —CN, —OH, —$OR^9$, —$SR^9$, —$N(R^{10})_2$, —$S(O)R^9$, —$S(O)_2R^9$, —$NHS(O)_2R^9$, —$S(O)_2N(R^{10})_2$, —$C(O)R^9$, —$C(O)OR^{10}$, —$OC(O)R^9$, —$C(O)N(R^{10})_2$, —$OC(O)N(R^{10})_2$, —$NR^{10}C(O)N(R^{10})_2$, —$NR^{10}C(O)R^9$, —$NR^{10}C(O)OR^9$, $C_{1-6}$alkyl, —$C_{1-6}$alkyl-OH, —$C_{1-6}$alkyl-$OR^9$, —$C_{1-6}$alkyl-$N(R^{10})_2$, $C_{2-6}$alkenyl, $C_{2-6}$alkynyl, $C_{1-6}$haloalkyl, $C_{3-8}$cycloalkyl, and —$C_{1-6}$alkyl-$C_{3-8}$cycloalkyl;

each $R^5$ are independently selected from H, halogen, —CN, —OH, —$OR^9$, —$SR^9$, —$N(R^{10})_2$, —$S(O)R^9$, —$S(O)_2R^9$, —$NHS(O)_2R^9$, —$S(O)_2N(R^{10})_2$, —$C(O)R^9$, —$C(O)OR^{10}$, —$OC(O)R^9$, —$C(O)N(R^{10})_2$, —$OC(O)N(R^{10})_2$, —$NR^{10}C(O)N(R^{10})_2$, —$NR^{10}C(O)R^9$, —$NR^{10}C(O)OR^9$, $C_{1-6}$alkyl, —$C_{1-6}$alkyl-OH, —$C_{1-6}$alkyl-$OR^9$, —$C_{1-6}$alkyl-$N(R^{10})_2$, $C_{2-6}$alkenyl, $C_{2-6}$alkynyl, $C_{1-6}$haloalkyl, $C_{3-8}$cycloalkyl, and —$C_{1-6}$alkyl-$C_{3-8}$cycloalkyl;

each $R^9$ is independently selected from $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, and —$C_{1-6}$alkyl-$C_{2-9}$heteroaryl, wherein $C_{1-6}$alkyl, phenyl, —$C_{1-6}$alkyl-phenyl, —$C_{1-6}$alkyl-$C_{2-9}$heterocycloalkyl, $C_{2-9}$heteroaryl, and —$C_{1-6}$alkyl-$C_{2-9}$heteroaryl are optionally substituted with one or two groups independently selected from $C_{1-6}$alkyl, —$OR^{11}$, —$N(R^{11})_2$, $C_{1-6}$alkyl, $C_{3-8}$cycloalkyl, —$C(O)R^{12}$, and —$C(O)OR^{12}$;

each $R^{10}$ is independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl, wherein $C_{1-6}$alkyl, phenyl, —$C_{1-6}$alkyl-phenyl, and $C_{2-9}$heteroaryl are optionally substituted with one or two groups independently selected from halogen, $C_{1-6}$alkyl, and —$N(R^{11})_2$; or two $R^{10}$ and the nitrogen atom to which they are attached are combined to form a 5- or 6-membered heterocycloalkyl ring optionally substituted with one, two, or three groups independently selected from $C_{1-6}$alkyl, oxo, and —$C(O)OH$;

each $R^{11}$ is independently selected from H and $C_{1-6}$alkyl;
each $R^{12}$ is independently selected from H and $C_{1-6}$alkyl;
p is 0, 1, 2, 3, 4, 5, or 6; and
q is 0, 1, 2, 3, or 4;
or a pharmaceutically acceptable salt or solvate thereof.

In some instances, the small molecule that binds GPR35 is a compound of Formula (XXVI):

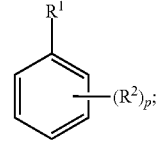

Formula (XXVI)

wherein:

$R^1$ is selected from —$C(O)OH$, —$C(O)OR^{10}$,

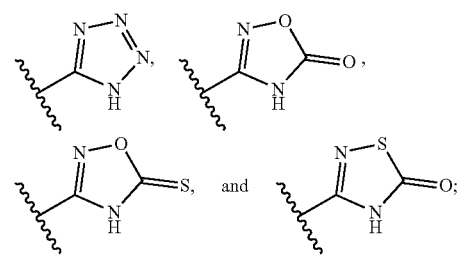

each $R^2$ is selected from halogen, —CN, —OH, —$OR^9$, —$SR^9$, —$N(R^{10})_2$, —$S(O)R^9$, —$S(O)_2R^9$, —$NHS(O)_2R^9$, —$S(O)_2N(R^{10})_2$, —$C(O)R^9$, —$C(O)OR^{10}$, —OC (O)R⁹, —C(O)N(R¹⁰)₂, —OC(O)N(R¹⁰)₂, —NR¹⁰C(O)N(R¹⁰)₂, —NR¹⁰C(O)R⁹, —NR¹⁰C(O)OR⁹, $C_{1-6}$alkyl, —$C_{1-6}$alkyl-OH, —$C_{1-6}$alkyl-OR⁹, —$C_{1-6}$alkyl-N(R¹⁰)₂, $C_{2-6}$alkenyl, $C_{2-6}$alkynyl, $C_{1-6}$haloalkyl, $C_{3-8}$cycloalkyl, and —$C_{1-6}$alkyl-$C_{3-8}$cycloalkyl;

each R⁹ is independently selected from $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, $C_{2-9}$heterocycloalkyl, —$C_{1-6}$alkyl-$C_{2-9}$heterocycloalkyl, $C_{2-9}$heteroaryl, and —$C_{1-6}$alkyl-$C_{2-9}$heteroaryl, wherein $C_{1-6}$alkyl, phenyl, —$C_{1-6}$alkyl-phenyl, —$C_{1-6}$alkyl-$C_{2-9}$heterocycloalkyl, $C_{2-9}$heteroaryl, and —$C_{1-6}$alkyl-$C_{2-9}$heteroaryl are optionally substituted with one or two groups independently selected from $C_{1-6}$alkyl, —OR¹¹, —N(R¹¹)₂, $C_{1-6}$alkyl, $C_{3-8}$cycloalkyl, —C(O)R¹², and —C(O)OR¹²;

each R¹⁰ is independently selected from H, $C_{1-6}$alkyl, $C_{1-6}$haloalkyl, $C_{3-8}$cycloalkyl, —$C_{1-6}$alkyl-$C_{3-8}$cycloalkyl, phenyl, —$C_{1-6}$alkyl-phenyl, and $C_{2-9}$heteroaryl, wherein $C_{1-6}$alkyl, phenyl, —$C_{1-6}$alkyl-phenyl, and $C_{2-9}$heteroaryl are optionally substituted with one or two groups independently selected from halogen, $C_{1-6}$alkyl, and —N(R¹¹)₂; or two R¹⁰ and the nitrogen atom to which they are attached are combined to form a 5- or 6-membered heterocycloalkyl ring optionally substituted with one, two, or three groups independently selected from $C_{1-6}$alkyl, oxo, and —C(O)OH;

each R¹¹ is independently selected from H and $C_{1-6}$alkyl;
each R¹² is independently selected from H and $C_{1-6}$alkyl;
p is 0, 1, 2, 3, or 4; and
or a pharmaceutically acceptable salt or solvate thereof.

In some instances, the small molecule that binds GPR35 is selected from zaprinast, lodoxamide, bufrolin, TC-G 1001, nedocromil, PSB-13253, 6-bromo-7-hydroxy-8-nitro-3-(1H-tetrazol-5-yl)-2H-chromen-2-one, 6-bromo-7-hydroxy-8-nitro-2-oxo-2H-chromene-3-carboxylic acid, 7-deshydroxypyrogallin-4-carboxylic acid (DCA), morin, cromolyn, T3, reverse T3, YE-210, cromoglicic acid, nedocromil, pamoic acid, and tyrphostin-51.

In some instances, the small molecule that binds GPR35 is selected from pamoic acid, amlexanox, furosemide, doxantrazole, kynurenic acid, DHICA, cyclic guanosine monophosphate (cGMP), 2,3,5-THB, ellagic acid, LPA species, and YE120.

In some instances, the small molecule that binds GPR35 is selected from ML-145, ML-194, and ML-144.

In some instances, the small molecule that binds GPR35 is selected from:

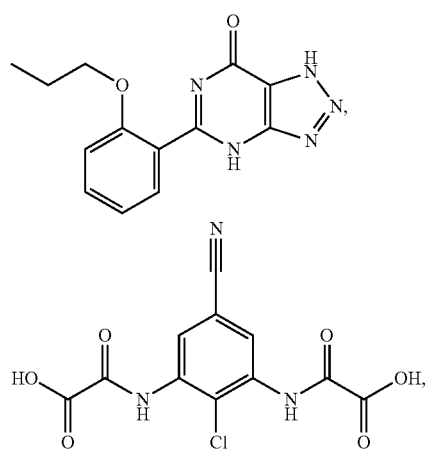

-continued

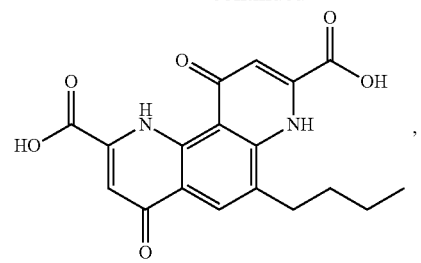

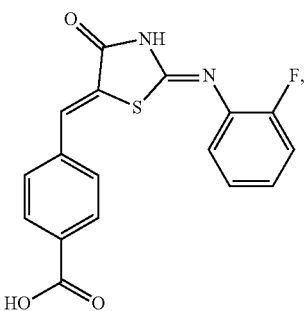

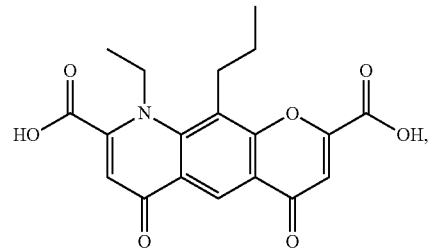

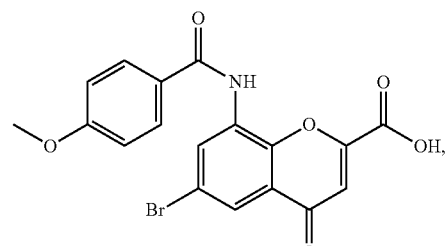

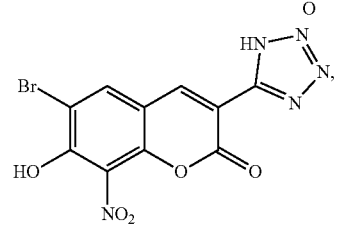

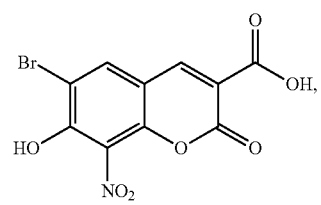

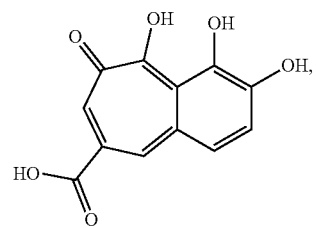

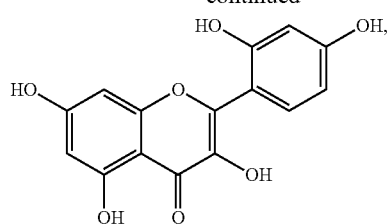
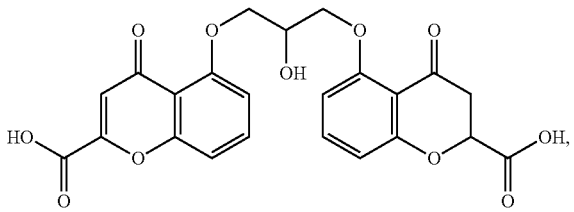
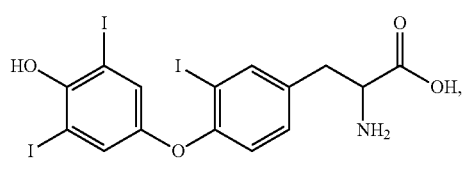
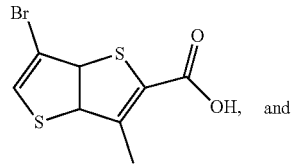
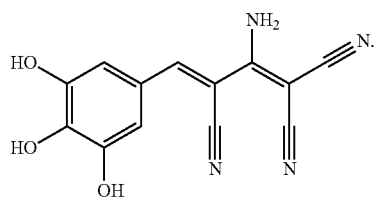
In some instances, the small molecule that binds GPR35 is selected from:
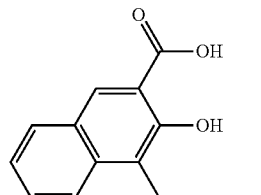
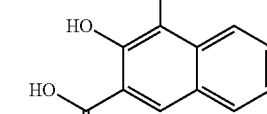
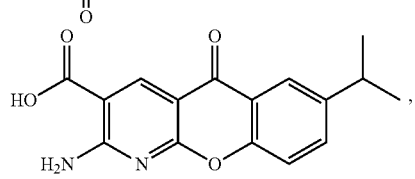
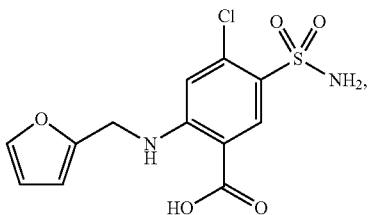
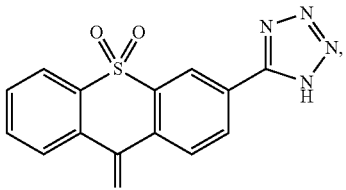
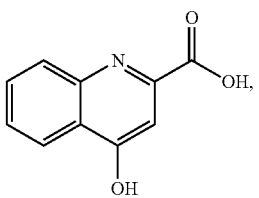
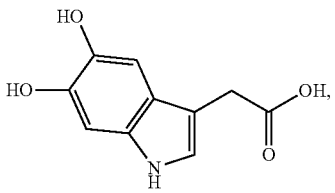
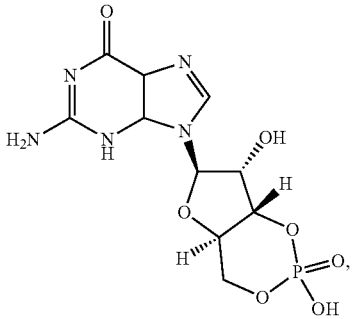
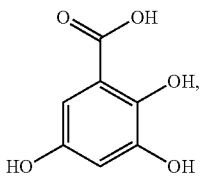
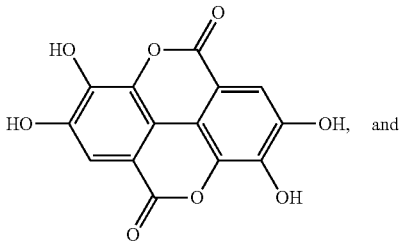

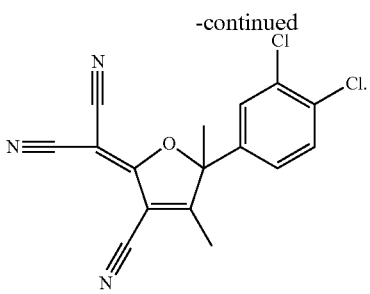

In some instances, the small molecule that binds GPR35 is selected from:

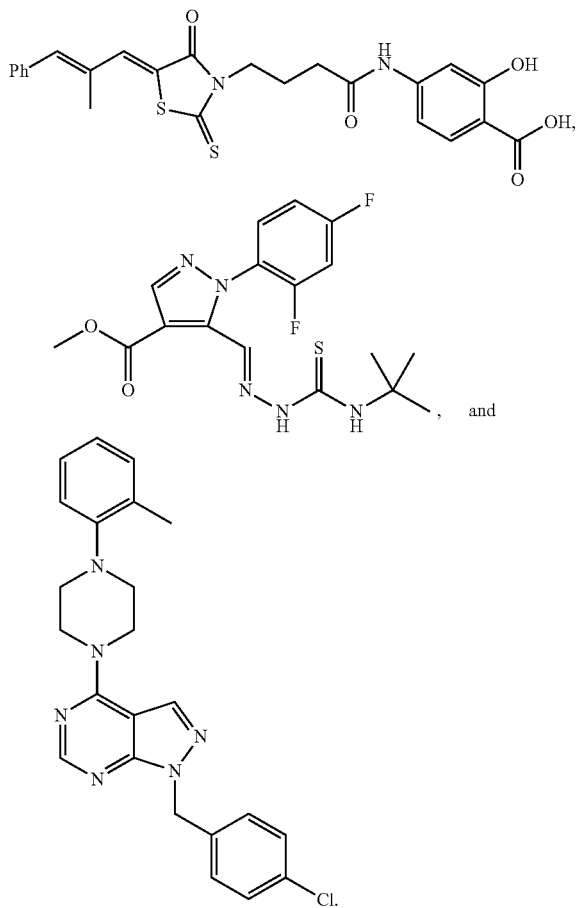

Pharmaceutical Composition

A pharmaceutical composition, as used herein, refers to a mixture of a therapeutic agent, with other chemical components (i.e. pharmaceutically acceptable inactive ingredients), such as carriers, excipients, binders, filling agents, suspending agents, flavoring agents, sweetening agents, disintegrating agents, dispersing agents, surfactants, lubricants, colorants, diluents, solubilizers, moistening agents, plasticizers, stabilizers, penetration enhancers, wetting agents, antifoaming agents, antioxidants, preservatives, or one or more combination thereof. Optionally, the compositions include two or more therapeutic agent (e.g., one or more therapeutic agents and one or more additional agents) as discussed herein. In practicing the methods of treatment or use provided herein, therapeutically effective amounts of therapeutic agents described herein are administered in a pharmaceutical composition to a mammal having a disease, disorder, or condition to be treated, e.g., an inflammatory disease, fibrostenotic disease, and/or fibrotic disease. In some embodiments, the mammal is a human. A therapeutically effective amount can vary widely depending on the severity of the disease, the age and relative health of the subject, the potency of the therapeutic agent used and other factors. The therapeutic agents can be used singly or in combination with one or more therapeutic agents as components of mixtures.

The pharmaceutical formulations described herein are administered to a subject by appropriate administration routes, including but not limited to, intravenous, intraarterial, oral, parenteral, buccal, topical, transdermal, rectal, intramuscular, subcutaneous, intraosseous, transmucosal, inhalation, or intraperitoneal administration routes. The pharmaceutical formulations described herein include, but are not limited to, aqueous liquid dispersions, self-emulsifying dispersions, solid solutions, liposomal dispersions, aerosols, solid dosage forms, powders, immediate release formulations, controlled release formulations, fast melt formulations, tablets, capsules, pills, delayed release formulations, extended release formulations, pulsatile release formulations, multiparticulate formulations, and mixed immediate and controlled release formulations.

Pharmaceutical compositions including a therapeutic agent are manufactured in a conventional manner, such as, by way of example only, by means of conventional mixing, dissolving, granulating, dragee-making, levigating, emulsifying, encapsulating, entrapping or compression processes.

The pharmaceutical compositions may include at least a therapeutic agent as an active ingredient in free-acid or free-base form, or in a pharmaceutically acceptable salt form. In addition, the methods and pharmaceutical compositions described herein include the use of N-oxides (if appropriate), crystalline forms, amorphous phases, as well as active metabolites of these compounds having the same type of activity. In some embodiments, therapeutic agents exist in unsolvated form or in solvated forms with pharmaceutically acceptable solvents such as water, ethanol, and the like. The solvated forms of the therapeutic agents are also considered to be disclosed herein.

In some embodiments, a therapeutic agent exists as a tautomer. All tautomers are included within the scope of the agents presented herein. As such, it is to be understood that a therapeutic agent or a salt thereof may exhibit the phenomenon of tautomerism whereby two chemical compounds that are capable of facile interconversion by exchanging a hydrogen atom between two atoms, to either of which it forms a covalent bond. Since the tautomeric compounds exist in mobile equilibrium with each other they may be regarded as different isomeric forms of the same compound.

In some embodiments, a therapeutic agent exists as an enantiomer, diastereomer, or other stereoisomeric form. The agents disclosed herein include all enantiomeric, diastereomeric, and epimeric forms as well as mixtures thereof.

In some embodiments, therapeutic agents described herein may be prepared as prodrugs. A "prodrug" refers to an agent that is converted into the parent drug in vivo. Prodrugs are often useful because, in some situations, they may be easier to administer than the parent drug. They may, for instance, be bioavailable by oral administration whereas the parent is not. The prodrug may also have improved solubility in pharmaceutical compositions over the parent drug. An example, without limitation, of a prodrug would be a therapeutic agent described herein, which is administered as an ester (the "prodrug") to facilitate transmittal across a cell membrane where water solubility is detrimental to mobility but which then is metabolically hydrolyzed to the carboxylic acid, the active entity, once inside the cell where water-solubility is beneficial. A further example of a prodrug might be a short peptide (polyaminoacid) bonded to an acid group where the peptide is metabolized to reveal the active moiety. In certain embodiments, upon in vivo administration, a prodrug is chemically converted to the biologically, pharmaceutically or therapeutically active form of the therapeutic agent. In certain embodiments, a prodrug is enzymatically metabolized by one or more steps or processes to the biologically, pharmaceutically or therapeutically active form of the therapeutic agent.

Prodrug forms of the therapeutic agents, wherein the prodrug is metabolized in vivo to produce an agent as set forth herein are included within the scope of the claims. Prodrug forms of the herein described therapeutic agents, wherein the prodrug is metabolized in vivo to produce an agent as set forth herein are included within the scope of the claims. In some cases, some of the therapeutic agents described herein may be a prodrug for another derivative or active compound. In some embodiments described herein, hydrazones are metabolized in vivo to produce a therapeutic agent.

In certain embodiments, compositions provided herein include one or more preservatives to inhibit microbial activity. Suitable preservatives include mercury-containing substances such as merfen and thiomersal; stabilized chlorine dioxide; and quaternary ammonium compounds such as benzalkonium chloride, cetyltrimethylammonium bromide and cetylpyridinium chloride.

In some embodiments, formulations described herein benefit from antioxidants, metal chelating agents, thiol containing compounds and other general stabilizing agents. Examples of such stabilizing agents, include, but are not limited to: (a) about 0.5% to about 2% w/v glycerol, (b) about 0.1% to about 1% w/v methionine, (c) about 0.1% to about 2% w/v monothioglycerol, (d) about 1 mM to about 10 mM EDTA, (e) about 0.01% to about 2% w/v ascorbic acid, (f) 0.003% to about 0.02% w/v polysorbate 80, (g) 0.001% to about 0.05% w/v. polysorbate 20, (h) arginine, (i) heparin, (j) dextran sulfate, (k) cyclodextrins, (l) pentosan polysulfate and other heparinoids, (m) divalent cations such as magnesium and zinc; or (n) combinations thereof.

The pharmaceutical compositions described herein are formulated into any suitable dosage form, including but not limited to, aqueous oral dispersions, liquids, gels, syrups, elixirs, slurries, suspensions, solid oral dosage forms, aerosols, controlled release formulations, fast melt formulations, effervescent formulations, lyophilized formulations, tablets, powders, pills, dragees, capsules, delayed release formulations, extended release formulations, pulsatile release formulations, multiparticulate formulations, and mixed immediate release and controlled release formulations. In one aspect, a therapeutic agent as discussed herein, e.g., therapeutic agent is formulated into a pharmaceutical composition suitable for intramuscular, subcutaneous, or intravenous injection. In one aspect, formulations suitable for intramuscular, subcutaneous, or intravenous injection include physiologically acceptable sterile aqueous or non-aqueous solutions, dispersions, suspensions or emulsions, and sterile powders for reconstitution into sterile injectable solutions or dispersions. Examples of suitable aqueous and non-aqueous carriers, diluents, solvents, or vehicles include water, ethanol, polyols (propyleneglycol, polyethylene-glycol, glycerol, cremophor and the like), suitable mixtures thereof, vegetable oils (such as olive oil) and injectable organic esters such as ethyl oleate. Proper fluidity can be maintained, for example, by the use of a coating such as lecithin, by the maintenance of the required particle size in the case of dispersions, and by the use of surfactants. In some embodiments, formulations suitable for subcutaneous injection also contain additives such as preserving, wetting, emulsifying, and dispensing agents. Prevention of the growth of microorganisms can be ensured by various antibacterial and antifungal agents, such as parabens, chlorobutanol, phenol, sorbic acid, and the like. In some cases it is desirable to include isotonic agents, such as sugars, sodium chloride, and the like. Prolonged absorption of the injectable pharmaceutical form can be brought about by the use of agents delaying absorption, such as aluminum monostearate and gelatin.

For intravenous injections or drips or infusions, a therapeutic agent described herein is formulated in aqueous solutions, preferably in physiologically compatible buffers such as Hank's solution, Ringer's solution, or physiological saline buffer. For transmucosal administration, penetrants appropriate to the barrier to be permeated are used in the formulation. Such penetrants are generally known in the art. For other parenteral injections, appropriate formulations include aqueous or nonaqueous solutions, preferably with physiologically compatible buffers or excipients. Such excipients are known.

Parenteral injections may involve bolus injection or continuous infusion. Formulations for injection may be presented in unit dosage form, e.g., in ampoules or in multi dose containers, with an added preservative. The pharmaceutical composition described herein may be in a form suitable for parenteral injection as a sterile suspensions, solutions or emulsions in oily or aqueous vehicles, and may contain formulatory agents such as suspending, stabilizing and/or dispersing agents. In one aspect, the active ingredient is in powder form for constitution with a suitable vehicle, e.g., sterile pyrogen-free water, before use.

For administration by inhalation, a therapeutic agent is formulated for use as an aerosol, a mist or a powder. Pharmaceutical compositions described herein are conveniently delivered in the form of an aerosol spray presentation from pressurized packs or a nebulizer, with the use of a suitable propellant, e.g., dichlorodifluoromethane, trichlorofluoromethane, dichlorotetrafluoroethane, carbon dioxide or other suitable gas. In the case of a pressurized aerosol, the dosage unit may be determined by providing a valve to deliver a metered amount. Capsules and cartridges of, such as, by way of example only, gelatin for use in an inhaler or insufflator may be formulated containing a powder mix of the therapeutic agent described herein and a suitable powder base such as lactose or starch.

Representative intranasal formulations are described in, for example, U.S. Pat. Nos. 4,476,116, 5,116,817 and 6,391,452. Formulations that include a therapeutic agent are prepared as solutions in saline, employing benzyl alcohol or other suitable preservatives, fluorocarbons, and/or other solubilizing or dispersing agents known in the art. See, for example, Ansel, H. C. et al., Pharmaceutical Dosage Forms and Drug Delivery Systems, Sixth Ed. (1995). Preferably these compositions and formulations are prepared with suitable nontoxic pharmaceutically acceptable ingredients. These ingredients are known to those skilled in the preparation of nasal dosage forms and some of these can be found in REMINGTON: THE SCIENCE AND PRACTICE OF PHARMACY, 21st edition, 2005. The choice of suitable carriers is dependent upon the exact nature of the nasal dosage form desired, e.g., solutions, suspensions, ointments, or gels. Nasal dosage forms generally contain large amounts of water in addition to the active ingredient. Minor amounts of other ingredients such as pH adjusters, emulsifiers or dispersing agents, preservatives, surfactants, gelling agents, or buffering and other stabilizing and solubilizing agents are optionally present. Preferably, the nasal dosage form should be isotonic with nasal secretions.

Pharmaceutical preparations for oral use are obtained by mixing one or more solid excipient with one or more of the therapeutic agents described herein, optionally grinding the resulting mixture, and processing the mixture of granules, after adding suitable auxiliaries, if desired, to obtain tablets or dragee cores. Suitable excipients include, for example, fillers such as sugars, including lactose, sucrose, mannitol, or sorbitol; cellulose preparations such as, for example, maize starch, wheat starch, rice starch, potato starch, gelatin, gum tragacanth, methylcellulose, microcrystalline cellulose, hydroxypropylmethylcellulose, sodium carboxymethylcellulose; or others such as: polyvinylpyrrolidone (PVP or povidone) or calcium phosphate. If desired, disintegrating agents are added, such as the cross linked croscarmellose sodium, polyvinylpyrrolidone, agar, or alginic acid or a salt thereof such as sodium alginate. In some embodiments, dyestuffs or pigments are added to the tablets or dragee coatings for identification or to characterize different combinations of active therapeutic agent doses.

In some embodiments, pharmaceutical formulations of a therapeutic agent are in the form of a capsules, including push fit capsules made of gelatin, as well as soft, sealed capsules made of gelatin and a plasticizer, such as glycerol or sorbitol. The push fit capsules contain the active ingredients in admixture with filler such as lactose, binders such as starches, and/or lubricants such as talc or magnesium stearate and, optionally, stabilizers. In soft capsules, the active therapeutic agent is dissolved or suspended in suitable liquids, such as fatty oils, liquid paraffin, or liquid polyethylene glycols. In some embodiments, stabilizers are added. A capsule may be prepared, for example, by placing the bulk blend of the formulation of the therapeutic agent inside of a capsule. In some embodiments, the formulations (non-aqueous suspensions and solutions) are placed in a soft gelatin capsule. In other embodiments, the formulations are placed in standard gelatin capsules or non-gelatin capsules such as capsules comprising HPMC. In other embodiments, the formulation is placed in a sprinkle capsule, wherein the capsule is swallowed whole or the capsule is opened and the contents sprinkled on food prior to eating.

All formulations for oral administration are in dosages suitable for such administration. In one aspect, solid oral dosage forms are prepared by mixing a therapeutic agent with one or more of the following: antioxidants, flavoring agents, and carrier materials such as binders, suspending agents, disintegration agents, filling agents, surfactants, solubilizers, stabilizers, lubricants, wetting agents, and diluents. In some embodiments, the solid dosage forms disclosed herein are in the form of a tablet, (including a suspension tablet, a fast-melt tablet, a bite-disintegration tablet, a rapid-disintegration tablet, an effervescent tablet, or a caplet), a pill, a powder, a capsule, solid dispersion, solid solution, bioerodible dosage form, controlled release formulations, pulsatile release dosage forms, multiparticulate dosage forms, beads, pellets, granules. In other embodiments, the pharmaceutical formulation is in the form of a powder. Compressed tablets are solid dosage forms prepared by compacting the bulk blend of the formulations described above. In various embodiments, tablets will include one or more flavoring agents. In other embodiments, the tablets will include a film surrounding the final compressed tablet. In some embodiments, the film coating can provide a delayed release of a therapeutic agent from the formulation. In other embodiments, the film coating aids in patient compliance (e.g., Opadry® coatings or sugar coating). Film coatings including Opadry® typically range from about 1% to about 3% of the tablet weight. In some embodiments, solid dosage forms, e.g., tablets, effervescent tablets, and capsules, are prepared by mixing particles of a therapeutic agent with one or more pharmaceutical excipients to form a bulk blend composition. The bulk blend is readily subdivided into equally effective unit dosage forms, such as tablets, pills, and capsules. In some embodiments, the individual unit dosages include film coatings. These formulations are manufactured by conventional formulation techniques.

In another aspect, dosage forms include microencapsulated formulations. In some embodiments, one or more other compatible materials are present in the microencapsulation material. Exemplary materials include, but are not limited to, pH modifiers, erosion facilitators, anti-foaming agents, antioxidants, flavoring agents, and carrier materials such as binders, suspending agents, disintegration agents, filling agents, surfactants, solubilizers, stabilizers, lubricants, wetting agents, and diluents. Exemplary useful microencapsulation materials include, but are not limited to, hydroxypropyl cellulose ethers (HPC) such as Klucel® or Nisso HPC, low-substituted hydroxypropyl cellulose ethers (L-HPC), hydroxypropyl methyl cellulose ethers (HPMC) such as Seppifilm-LC, Pharmacoat®, Metolose SR, Methocel®-E, Opadry YS, PrimaFlo, Benecel MP824, and Benecel MP843, methylcellulose polymers such as Methocel®-A, hydroxypropylmethylcellulose acetate stearate Aqoat (HF-LS, HF-LG, HF-MS) and Metolose®, Ethylcelluloses (EC) and mixtures thereof such as E461, Ethocel®, Aqualon®-EC, Surelease®, Polyvinyl alcohol (PVA) such as Opadry AMB, hydroxyethylcelluloses such as Natrosol®, carboxymethylcelluloses and salts of carboxymethylcelluloses (CMC) such as Aqualon®-CMC, polyvinyl alcohol and polyethylene glycol co-polymers such as Kollicoat IR®, monoglycerides (Myverol), triglycerides (KLX), polyethylene glycols, modified food starch, acrylic polymers and mixtures of acrylic polymers with cellulose ethers such as Eudragit® EPO, Eudragit® L30D-55, Eudragit® FS 30D Eudragit® L100-55, Eudragit® L100, Eudragit® S100, Eudragit® RD100, Eudragit® E100, Eudragit® L12.5, Eudragit® S12.5, Eudragit® NE30D, and Eudragit® NE 40D, cellulose acetate phthalate, sepifilms such as mixtures of HPMC and stearic acid, cyclodextrins, and mixtures of these materials.

Liquid formulation dosage forms for oral administration are optionally aqueous suspensions selected from the group including, but not limited to, pharmaceutically acceptable aqueous oral dispersions, emulsions, solutions, elixirs, gels, and syrups. See, e.g., Singh et al., Encyclopedia of Pharmaceutical Technology, 2nd Ed., pp. 754-757 (2002). In addition to therapeutic agent the liquid dosage forms optionally include additives, such as: (a) disintegrating agents; (b) dispersing agents; (c) wetting agents; (d) at least one preservative, (e) viscosity enhancing agents, (f) at least one sweetening agent, and (g) at least one flavoring agent. In some embodiments, the aqueous dispersions further includes a crystal-forming inhibitor.

In some embodiments, the pharmaceutical formulations described herein are self-emulsifying drug delivery systems (SEDDS). Emulsions are dispersions of one immiscible phase in another, usually in the form of droplets. Generally, emulsions are created by vigorous mechanical dispersion.

SEDDS, as opposed to emulsions or microemulsions, spontaneously form emulsions when added to an excess of water without any external mechanical dispersion or agitation. An advantage of SEDDS is that only gentle mixing is required to distribute the droplets throughout the solution. Additionally, water or the aqueous phase is optionally added just prior to administration, which ensures stability of an unstable or hydrophobic active ingredient. Thus, the SEDDS provides an effective delivery system for oral and parenteral delivery of hydrophobic active ingredients. In some embodiments, SEDDS provides improvements in the bioavailability of hydrophobic active ingredients. Methods of producing self-emulsifying dosage forms include, but are not limited to, for example, U.S. Pat. Nos. 5,858,401, 6,667,048, and 6,960,563.

Buccal formulations that include a therapeutic agent are administered using a variety of formulations known in the art. For example, such formulations include, but are not limited to, U.S. Pat. Nos. 4,229,447, 4,596,795, 4,755,386, and 5,739,136. In addition, the buccal dosage forms described herein can further include a bioerodible (hydrolysable) polymeric carrier that also serves to adhere the dosage form to the buccal mucosa. For buccal or sublingual administration, the compositions may take the form of tablets, lozenges, or gels formulated in a conventional manner.

For intravenous injections, a therapeutic agent is optionally formulated in aqueous solutions, preferably in physiologically compatible buffers such as Hank's solution, Ringer's solution, or physiological saline buffer. For transmucosal administration, penetrants appropriate to the barrier to be permeated are used in the formulation. For other parenteral injections, appropriate formulations include aqueous or nonaqueous solutions, preferably with physiologically compatible buffers or excipients.

Parenteral injections optionally involve bolus injection or continuous infusion. Formulations for injection are optionally presented in unit dosage form, e.g., in ampoules or in multi dose containers, with an added preservative. In some embodiments, a pharmaceutical composition described herein is in a form suitable for parenteral injection as a sterile suspensions, solutions or emulsions in oily or aqueous vehicles, and contain formulatory agents such as suspending, stabilizing and/or dispersing agents. Pharmaceutical formulations for parenteral administration include aqueous solutions of an agent that modulates the activity of a carotid body in water soluble form. Additionally, suspensions of an agent that modulates the activity of a carotid body are optionally prepared as appropriate, e.g., oily injection suspensions.

Conventional formulation techniques include, e.g., one or a combination of methods: (1) dry mixing, (2) direct compression, (3) milling, (4) dry or non-aqueous granulation, (5) wet granulation, or (6) fusion. Other methods include, e.g., spray drying, pan coating, melt granulation, granulation, fluidized bed spray drying or coating (e.g., wurster coating), tangential coating, top spraying, tableting, extruding and the like.

Suitable carriers for use in the solid dosage forms described herein include, but are not limited to, acacia, gelatin, colloidal silicon dioxide, calcium glycerophosphate, calcium lactate, maltodextrin, glycerine, magnesium silicate, sodium caseinate, soy lecithin, sodium chloride, tricalcium phosphate, dipotassium phosphate, sodium stearoyl lactylate, carrageenan, monoglyceride, diglyceride, pregelatinized starch, hydroxypropylmethylcellulose, hydroxypropylmethylcellulose acetate stearate, sucrose, microcrystalline cellulose, lactose, mannitol and the like.

Suitable filling agents for use in the solid dosage forms described herein include, but are not limited to, lactose, calcium carbonate, calcium phosphate, dibasic calcium phosphate, calcium sulfate, microcrystalline cellulose, cellulose powder, dextrose, dextrates, dextran, starches, pregelatinized starch, hydroxypropylmethycellulose (HPMC), hydroxypropylmethycellulose phthalate, hydroxypropylmethylcellulose acetate stearate (HPMCAS), sucrose, xylitol, lactitol, mannitol, sorbitol, sodium chloride, polyethylene glycol, and the like.

Suitable disintegrants for use in the solid dosage forms described herein include, but are not limited to, natural starch such as corn starch or potato starch, a pregelatinized starch, or sodium starch glycolate, a cellulose such as methylcrystalline cellulose, methylcellulose, microcrystalline cellulose, croscarmellose, or a cross-linked cellulose, such as cross-linked sodium carboxymethylcellulose, cross-linked carboxymethylcellulose, or cross-linked croscarmellose, a cross-linked starch such as sodium starch glycolate, a cross-linked polymer such as crospovidone, a cross-linked polyvinylpyrrolidone, alginate such as alginic acid or a salt of alginic acid such as sodium alginate, a gum such as agar, guar, locust bean, Karaya, pectin, or tragacanth, sodium starch glycolate, bentonite, sodium lauryl sulfate, sodium lauryl sulfate in combination starch, and the like.

Binders impart cohesiveness to solid oral dosage form formulations: for powder filled capsule formulation, they aid in plug formation that can be filled into soft or hard shell capsules and for tablet formulation, they ensure the tablet remaining intact after compression and help assure blend uniformity prior to a compression or fill step. Materials suitable for use as binders in the solid dosage forms described herein include, but are not limited to, carboxymethylcellulose, methylcellulose, hydroxypropylmethylcellulose, hydroxypropylmethylcellulose acetate stearate, hydroxyethylcellulose, hydroxypropylcellulose, ethylcellulose, and microcrystalline cellulose, microcrystalline dextrose, amylose, magnesium aluminum silicate, polysaccharide acids, bentonites, gelatin, polyvinylpyrrolidone/vinyl acetate copolymer, crospovidone, povidone, starch, pregelatinized starch, tragacanth, dextrin, a sugar, such as sucrose, glucose, dextrose, molasses, mannitol, sorbitol, xylitol, lactose, a natural or synthetic gum such as acacia, tragacanth, ghatti gum, mucilage of isapol husks, starch, polyvinylpyrrolidone, larch arabogalactan, polyethylene glycol, waxes, sodium alginate, and the like.

In general, binder levels of 20-70% are used in powder-filled gelatin capsule formulations. Binder usage level in tablet formulations varies whether direct compression, wet granulation, roller compaction, or usage of other excipients such as fillers which itself can act as moderate binder. Binder levels of up to 70% in tablet formulations is common.

Suitable lubricants or glidants for use in the solid dosage forms described herein include, but are not limited to, stearic acid, calcium hydroxide, talc, corn starch, sodium stearyl fumerate, alkali-metal and alkaline earth metal salts, such as aluminum, calcium, magnesium, zinc, stearic acid, sodium stearates, magnesium stearate, zinc stearate, waxes, Stearowet®, boric acid, sodium benzoate, sodium acetate, sodium chloride, leucine, a polyethylene glycol or a methoxypolyethylene glycol such as Carbowax™, PEG 4000, PEG 5000, PEG 6000, propylene glycol, sodium oleate, glyceryl behenate, glyceryl palmitostearate, glyceryl benzoate, magnesium or sodium lauryl sulfate, and the like.

Suitable diluents for use in the solid dosage forms described herein include, but are not limited to, sugars (including lactose, sucrose, and dextrose), polysaccharides (including dextrates and maltodextrin), polyols (including mannitol, xylitol, and sorbitol), cyclodextrins and the like.

Suitable wetting agents for use in the solid dosage forms described herein include, for example, oleic acid, glyceryl monostearate, sorbitan monooleate, sorbitan monolaurate, triethanolamine oleate, polyoxyethylene sorbitan monooleate, polyoxyethylene sorbitan monolaurate, quaternary ammonium compounds (e.g., Polyquat 10®), sodium oleate, sodium lauryl sulfate, magnesium stearate, sodium docusate, triacetin, vitamin E TPGS and the like.

Suitable surfactants for use in the solid dosage forms described herein include, for example, sodium lauryl sulfate, sorbitan monooleate, polyoxyethylene sorbitan monooleate, polysorbates, polaxomers, bile salts, glyceryl monostearate, copolymers of ethylene oxide and propylene oxide, e.g., Pluronic® (BASF), and the like.

Suitable suspending agents for use in the solid dosage forms described here include, but are not limited to, polyvinylpyrrolidone, e.g., polyvinylpyrrolidone K12, polyvinylpyrrolidone K17, polyvinylpyrrolidone K25, or polyvinylpyrrolidone K30, polyethylene glycol, e.g., the polyethylene glycol can have a molecular weight of about 300 to about 6000, or about 3350 to about 4000, or about 7000 to about 5400, vinyl pyrrolidone/vinyl acetate copolymer (S630), sodium carboxymethylcellulose, methylcellulose, hydroxypropylmethylcellulose, polysorbate-80, hydroxyethylcellulose, sodium alginate, gums, such as, e.g., gum tragacanth and gum acacia, guar gum, xanthans, including xanthan gum, sugars, cellulosics, such as, e.g., sodium carboxymethylcellulose, methylcellulose, sodium carboxymethylcellulose, hydroxypropylmethylcellulose, hydroxyethylcellulose, polysorbate-80, sodium alginate, polyethoxylated sorbitan monolaurate, polyethoxylated sorbitan monolaurate, povidone and the like.

Suitable antioxidants for use in the solid dosage forms described herein include, for example, e.g., butylated hydroxytoluene (BHT), sodium ascorbate, and tocopherol.

It should be appreciated that there is considerable overlap between additives used in the solid dosage forms described herein. Thus, the above-listed additives should be taken as merely exemplary, and not limiting, of the types of additives that can be included in solid dosage forms of the pharmaceutical compositions described herein. The amounts of such additives can be readily determined by one skilled in the art, according to the particular properties desired.

In various embodiments, the particles of a therapeutic agents and one or more excipients are dry blended and compressed into a mass, such as a tablet, having a hardness sufficient to provide a pharmaceutical composition that substantially disintegrates within less than about 30 minutes, less than about 35 minutes, less than about 40 minutes, less than about 45 minutes, less than about 50 minutes, less than about 55 minutes, or less than about 60 minutes, after oral administration, thereby releasing the formulation into the gastrointestinal fluid.

In other embodiments, a powder including a therapeutic agent is formulated to include one or more pharmaceutical excipients and flavors. Such a powder is prepared, for example, by mixing the therapeutic agent and optional pharmaceutical excipients to form a bulk blend composition. Additional embodiments also include a suspending agent and/or a wetting agent. This bulk blend is uniformly subdivided into unit dosage packaging or multi-dosage packaging units.

In still other embodiments, effervescent powders are also prepared. Effervescent salts have been used to disperse medicines in water for oral administration.

In some embodiments, the pharmaceutical dosage forms are formulated to provide a controlled release of a therapeutic agent. Controlled release refers to the release of the therapeutic agent from a dosage form in which it is incorporated according to a desired profile over an extended period of time. Controlled release profiles include, for example, sustained release, prolonged release, pulsatile release, and delayed release profiles. In contrast to immediate release compositions, controlled release compositions allow delivery of an agent to a subject over an extended period of time according to a predetermined profile. Such release rates can provide therapeutically effective levels of agent for an extended period of time and thereby provide a longer period of pharmacologic response while minimizing side effects as compared to conventional rapid release dosage forms. Such longer periods of response provide for many inherent benefits that are not achieved with the corresponding short acting, immediate release preparations.

In some embodiments, the solid dosage forms described herein are formulated as enteric coated delayed release oral dosage forms, i.e., as an oral dosage form of a pharmaceutical composition as described herein which utilizes an enteric coating to affect release in the small intestine or large intestine. In one aspect, the enteric coated dosage form is a compressed or molded or extruded tablet/mold (coated or uncoated) containing granules, powder, pellets, beads or particles of the active ingredient and/or other composition components, which are themselves coated or uncoated. In one aspect, the enteric coated oral dosage form is in the form of a capsule containing pellets, beads or granules, which include a therapeutic agent that are coated or uncoated.

Any coatings should be applied to a sufficient thickness such that the entire coating does not dissolve in the gastrointestinal fluids at pH below about 5, but does dissolve at pH about 5 and above. Coatings are typically selected from any of the following: Shellac—this coating dissolves in media of pH>7; Acrylic polymers—examples of suitable acrylic polymers include methacrylic acid copolymers and ammonium methacrylate copolymers. The Eudragit series E, L, S, RL, RS and NE (Rohm Pharma) are available as solubilized in organic solvent, aqueous dispersion, or dry powders. The Eudragit series RL, NE, and RS are insoluble in the gastrointestinal tract but are permeable and are used primarily for colonic targeting. The Eudragit series E dissolve in the stomach. The Eudragit series L, L-30D and S are insoluble in stomach and dissolve in the intestine; Poly Vinyl Acetate Phthalate (PVAP)—PVAP dissolves in pH>5, and it is much less permeable to water vapor and gastric fluids. Conventional coating techniques such as spray or pan coating are employed to apply coatings. The coating thickness must be sufficient to ensure that the oral dosage form remains intact until the desired site of topical delivery in the intestinal tract is reached.

In other embodiments, the formulations described herein are delivered using a pulsatile dosage form. A pulsatile dosage form is capable of providing one or more immediate release pulses at predetermined time points after a controlled lag time or at specific sites. Exemplary pulsatile dosage forms and methods of their manufacture are disclosed in U.S. Pat. Nos. 5,011,692, 5,017,381, 5,229,135, 5,840,329 and 5,837,284. In one embodiment, the pulsatile dosage form includes at least two groups of particles, (i.e. multiparticulate) each containing the formulation described herein. The first group of particles provides a substantially immediate dose of a therapeutic agent upon ingestion by a mammal. The first group of particles can be either uncoated or include a coating and/or sealant. In one aspect, the second group of particles comprises coated particles. The coating on the second group of particles provides a delay of from about 2 hours to about 7 hours following ingestion before release of the second dose. Suitable coatings for pharmaceutical compositions are described herein or known in the art.

In some embodiments, pharmaceutical formulations are provided that include particles of a therapeutic agent and at least one dispersing agent or suspending agent for oral administration to a subject. The formulations may be a powder and/or granules for suspension, and upon admixture with water, a substantially uniform suspension is obtained.

In some embodiments, particles formulated for controlled release are incorporated in a gel or a patch or a wound dressing.

In one aspect, liquid formulation dosage forms for oral administration and/or for topical administration as a wash are in the form of aqueous suspensions selected from the group including, but not limited to, pharmaceutically acceptable aqueous oral dispersions, emulsions, solutions, elixirs, gels, and syrups. See, e.g., Singh et al., Encyclopedia of Pharmaceutical Technology, 2nd Ed., pp. 754-757 (2002). In addition to the particles of a therapeutic agent, the liquid dosage forms include additives, such as: (a) disintegrating agents; (b) dispersing agents; (c) wetting agents; (d) at least one preservative, (e) viscosity enhancing agents, (f) at least one sweetening agent, and (g) at least one flavoring agent. In some embodiments, the aqueous dispersions can further include a crystalline inhibitor.

In some embodiments, the liquid formulations also include inert diluents commonly used in the art, such as water or other solvents, solubilizing agents, and emulsifiers. Exemplary emulsifiers are ethyl alcohol, isopropyl alcohol, ethyl carbonate, ethyl acetate, benzyl alcohol, benzyl benzoate, propyleneglycol, 1,3-butyleneglycol, dimethylformamide, sodium lauryl sulfate, sodium docusate, cholesterol, cholesterol esters, taurocholic acid, phosphatidylcholine, oils, such as cottonseed oil, groundnut oil, corn germ oil, olive oil, castor oil, and sesame oil, glycerol, tetrahydrofurfuryl alcohol, polyethylene glycols, fatty acid esters of sorbitan, or mixtures of these substances, and the like.

Furthermore, pharmaceutical compositions optionally include one or more pH adjusting agents or buffering agents, including acids such as acetic, boric, citric, lactic, phosphoric and hydrochloric acids; bases such as sodium hydroxide, sodium phosphate, sodium borate, sodium citrate, sodium acetate, sodium lactate and tris-hydroxymethylaminomethane; and buffers such as citrate/dextrose, sodium bicarbonate and ammonium chloride. Such acids, bases and buffers are included in an amount required to maintain pH of the composition in an acceptable range.

Additionally, pharmaceutical compositions optionally include one or more salts in an amount required to bring osmolality of the composition into an acceptable range. Such salts include those having sodium, potassium or ammonium cations and chloride, citrate, ascorbate, borate, phosphate, bicarbonate, sulfate, thiosulfate or bisulfite anions; suitable salts include sodium chloride, potassium chloride, sodium thiosulfate, sodium bisulfite and ammonium sulfate.

Other pharmaceutical compositions optionally include one or more preservatives to inhibit microbial activity. Suitable preservatives include mercury-containing substances such as merfen and thiomersal; stabilized chlorine dioxide; and quaternary ammonium compounds such as benzalkonium chloride, cetyltrimethylammonium bromide and cetylpyridinium chloride.

In one embodiment, the aqueous suspensions and dispersions described herein remain in a homogenous state, as defined in The USP Pharmacists' Pharmacopeia (2005 edition, chapter 905), for at least 4 hours. In one embodiment, an aqueous suspension is re-suspended into a homogenous suspension by physical agitation lasting less than 1 minute. In still another embodiment, no agitation is necessary to maintain a homogeneous aqueous dispersion.

Examples of disintegrating agents for use in the aqueous suspensions and dispersions include, but are not limited to, a starch, e.g., a natural starch such as corn starch or potato starch, a pregelatinized starch, or sodium starch glycolate; a cellulose such as methylcrystalline cellulose, methylcellulose, croscarmellose, or a cross-linked cellulose, such as cross-linked sodium carboxymethylcellulose, cross-linked carboxymethylcellulose, or cross-linked croscarmellose; a cross-linked starch such as sodium starch glycolate; a cross-linked polymer such as crospovidone; a cross-linked polyvinylpyrrolidone; alginate such as alginic acid or a salt of alginic acid such as sodium alginate; a gum such as agar, guar, locust bean, Karaya, pectin, or tragacanth; sodium starch glycolate; bentonite; a natural sponge; a surfactant; a resin such as a cation-exchange resin; citrus pulp; sodium lauryl sulfate; sodium lauryl sulfate in combination starch; and the like.

In some embodiments, the dispersing agents suitable for the aqueous suspensions and dispersions described herein include, for example, hydrophilic polymers, electrolytes, Tween® 60 or 80, PEG, polyvinylpyrrolidone, and the carbohydrate-based dispersing agents such as, for example, hydroxypropylcellulose and hydroxypropyl cellulose ethers, hydroxypropyl methylcellulose and hydroxypropyl methylcellulose ethers, carboxymethylcellulose sodium, methylcellulose, hydroxyethylcellulose, hydroxypropylmethyl-cellulose phthalate, hydroxypropylmethyl-cellulose acetate stearate, noncrystalline cellulose, magnesium aluminum silicate, triethanolamine, polyvinyl alcohol (PVA), polyvinylpyrrolidone/vinyl acetate copolymer, 4-(1,1,3,3-tetramethylbutyl)-phenol polymer with ethylene oxide and formaldehyde (also known as tyloxapol), poloxamers; and poloxamines. In other embodiments, the dispersing agent is selected from a group not comprising one of the following agents: hydrophilic polymers; electrolytes; Tween® 60 or 80; PEG; polyvinylpyrrolidone (PVP); hydroxypropylcellulose and hydroxypropyl cellulose ethers; hydroxypropyl methylcellulose and hydroxypropyl methylcellulose ethers; carboxymethylcellulose sodium; methylcellulose; hydroxyethylcellulose; hydroxypropylmethyl-cellulose phthalate; hydroxypropylmethyl-cellulose acetate stearate; noncrystalline cellulose; magnesium aluminum silicate; triethanolamine; polyvinyl alcohol (PVA); 4-(1,1,3,3-tetramethylbutyl)-phenol polymer with ethylene oxide and formaldehyde; poloxamers; or poloxamines.

Wetting agents suitable for the aqueous suspensions and dispersions described herein include, but are not limited to, cetyl alcohol, glycerol monostearate, polyoxyethylene sorbitan fatty acid esters (e.g., the commercially available Tweens® such as e.g., Tween 20® and Tween 80®, and polyethylene glycols, oleic acid, glyceryl monostearate, sorbitan monooleate, sorbitan monolaurate, triethanolamine oleate, polyoxyethylene sorbitan monooleate, polyoxyethylene sorbitan monolaurate, sodium oleate, sodium lauryl sulfate, sodium docusate, triacetin, vitamin E TPGS, sodium taurocholate, simethicone, phosphatidylcholine and the like.

Suitable preservatives for the aqueous suspensions or dispersions described herein include, for example, potassium sorbate, parabens (e.g., methylparaben and propylparaben), benzoic acid and its salts, other esters of parahydroxybenzoic acid such as butylparaben, alcohols such as ethyl alcohol or benzyl alcohol, phenolic compounds such as phenol, or quaternary compounds such as benzalkonium chloride. Preservatives, as used herein, are incorporated into the dosage form at a concentration sufficient to inhibit microbial growth.

Suitable viscosity enhancing agents for the aqueous suspensions or dispersions described herein include, but are not limited to, methyl cellulose, xanthan gum, carboxymethyl cellulose, hydroxypropyl cellulose, hydroxypropylmethyl cellulose, Plasdon® S-630, carbomer, polyvinyl alcohol, alginates, acacia, chitosans and combinations thereof. The concentration of the viscosity enhancing agent will depend upon the agent selected and the viscosity desired.

Examples of sweetening agents suitable for the aqueous suspensions or dispersions described herein include, for example, acacia syrup, acesulfame K, alitame, aspartame, chocolate, cinnamon, citrus, cocoa, cyclamate, dextrose, fructose, ginger, glycyrrhetinate, *glycyrrhiza* (licorice) syrup, monoammonium glyrrhizinate (MagnaSweet®), malitol, mannitol, menthol, neohesperidine DC, neotame, Prosweet® Powder, saccharin, sorbitol, *stevia*, sucralose, sucrose, sodium saccharin, saccharin, aspartame, acesulfame potassium, mannitol, sucralose, tagatose, thaumatin, vanilla, xylitol, or any combination thereof.

In some embodiments, a therapeutic agent is prepared as transdermal dosage form. In some embodiments, the transdermal formulations described herein include at least three components: (1) a therapeutic agent; (2) a penetration enhancer; and (3) an optional aqueous adjuvant. In some embodiments the transdermal formulations include additional components such as, but not limited to, gelling agents, creams and ointment bases, and the like. In some embodiments, the transdermal formulation is presented as a patch or a wound dressing. In some embodiments, the transdermal formulation further include a woven or non-woven backing material to enhance absorption and prevent the removal of the transdermal formulation from the skin. In other embodiments, the transdermal formulations described herein can maintain a saturated or supersaturated state to promote diffusion into the skin.

In one aspect, formulations suitable for transdermal administration of a therapeutic agent described herein employ transdermal delivery devices and transdermal delivery patches and can be lipophilic emulsions or buffered, aqueous solutions, dissolved and/or dispersed in a polymer or an adhesive. In one aspect, such patches are constructed for continuous, pulsatile, or on demand delivery of pharmaceutical agents. Still further, transdermal delivery of the therapeutic agents described herein can be accomplished by means of iontophoretic patches and the like. In one aspect, transdermal patches provide controlled delivery of a therapeutic agent. In one aspect, transdermal devices are in the form of a bandage comprising a backing member, a reservoir containing the therapeutic agent optionally with carriers, optionally a rate controlling barrier to deliver the therapeutic agent to the skin of the host at a controlled and predetermined rate over a prolonged period of time, and means to secure the device to the skin.

In further embodiments, topical formulations include gel formulations (e.g., gel patches which adhere to the skin). In some of such embodiments, a gel composition includes any polymer that forms a gel upon contact with the body (e.g., gel formulations comprising hyaluronic acid, pluronic polymers, poly(lactic-co-glycolic acid (PLGA)-based polymers or the like). In some forms of the compositions, the formulation comprises a low-melting wax such as, but not limited to, a mixture of fatty acid glycerides, optionally in combination with cocoa butter which is first melted. Optionally, the formulations further comprise a moisturizing agent.

In certain embodiments, delivery systems for pharmaceutical therapeutic agents may be employed, such as, for example, liposomes and emulsions. In certain embodiments, compositions provided herein can also include an mucoadhesive polymer, selected from among, for example, carboxymethylcellulose, carbomer (acrylic acid polymer), poly (methylmethacrylate), polyacrylamide, polycarbophil, acrylic acid/butyl acrylate copolymer, sodium alginate and dextran.

In some embodiments, a therapeutic agent described herein may be administered topically and can be formulated into a variety of topically administrable compositions, such as solutions, suspensions, lotions, gels, pastes, medicated sticks, balms, creams or ointments. Such pharmaceutical therapeutic agents can contain solubilizers, stabilizers, tonicity enhancing agents, buffers and preservatives.

Methods of Monitoring Treatment

In certain embodiments, described herein are methods for evaluating an effect of a treatment described herein. In some instances, the treatment comprises administration with an inhibitor of TL1A activity or expression and optionally, one or more additional therapeutic agents. In some instances, the treatment is monitored by evaluating the quantity of TL1A in the subject prior to and/or after administration of a therapeutic agent.

I. NUMBERED EMBODIMENTS

Non-limiting embodiments of the present disclosure include the following:

1. A method of inhibiting or reducing TL1A activity or expression in a subject having or suspected of having at least one of an inflammatory, fibrostenotic, and fibrotic, disease or condition the method comprising:
    a) identifying the subject as being a carrier of a genotype comprising a polymorphism provided in Table 1 or Table 4, or a polymorphism in linkage disequilibrium (LD) therewith; and
    b) administering to the subject a therapeutically effective amount of an anti-TL1A antibody, thereby inhibiting or reducing TL1A activity or expression in the subject.
2. The method of embodiment 1, provided that the inflammatory disease comprises Crohn's disease.
3. The method of embodiment 2, provided that the Crohn's disease comprises ileal, ileocolonic, or colonic Crohn's disease.
4. The method of embodiment 1, provided that the inflammatory disease comprises ulcerative colitis (UC).
5. The method of embodiment 4, provided that the UC is medically refractory UC.
6. The method of any of embodiments 1-5, wherein identifying the subject as being a carrier of the genotype of step (a) comprises:
    a) contacting a sample comprising genetic material from the subject with a nucleic acid sequence capable of hybridizing to at least 10 contiguous nucleobases comprising a risk allele located at nucleoposition 501 within any one of SEQ ID NOS: 1-48, or 57-59; and b) detecting binding between the nucleic acid sequence and the at least 10 contiguous nucleobases comprising the risk allele.
7. The method of embodiment 6, provided that the standard hybridization conditions comprise an annealing temperature between about 35° C. and about 65° C.
8. The method of embodiment 6 or embodiment 7, provided that the standard hybridization conditions are performed with a TaqMan master mix solution.
9. The method of any of embodiments 6-8, provided that the nucleic acid sequence is conjugated to a detectable molecule.
10. The method of embodiment 9, provided that the detectable molecule comprises a fluorophore.
11. The method of any of embodiments 6-10, provided that the nucleic acid sequence is conjugated to a quencher.
12. The method of any of embodiments 6-11, provided that the sample comprising genetic material from the subject is amplified genetic material obtained from a nucleic acid amplification assay.
13. The method of embodiment 12, provided that the nucleic acid amplification assay comprises amplification of DNA from the subject with a pair of primers capable of amplifying at least 15 contiguous nucleobases comprising the risk allele located at nucleoposition 501 within any one of SEQ ID NOS: 1-48, or 57-59, the pair of primers comprising a first primer and a second primer.
14. The method of embodiment 12, provided that the first primer comprises a nucleic acid sequence complimentary to at least 15 contiguous nucleobases upstream of the risk allele located at nucleobase 501 within any one of SEQ ID NOS: 1-48, or 57-59, and the second primer comprises a nucleic acid sequence complimentary to at least 15 contiguous nucleobases downstream of the risk allele located at nucleobase 501 within any one of SEQ ID NOS: 1-48, or 57-59.
15. The method of any of embodiments 1-14, provided that the subject has been determined to be a carrier of the genotype by a process comprising DNA sequencing.
16. The method of any of embodiments 1-15, provided that the subject further comprises soluble TL1A at a level greater than a control level derived from a non-diseased individual or population of non-diseased individuals.
17. The method of any of embodiments 1-16, provided that the subject is homozygous for the genotype.
18. The method of any of embodiments 1-17, wherein the genotype comprises at least two polymorphisms provided in Table 1 or Table 4.
19. The method of any of embodiments 1-17, wherein the genotype comprises at least three polymorphisms provided in Table 1 or Table 4.
20. The method of any of embodiments 1-19, wherein the genotype comprises a polymorphism selected from the group consisting of a "G" allele at rs11897732 (SEQ ID NO: 1), an "A" allele at rs6740739 (SEQ ID NO: 2), a "G" allele at rs17796285 (SEQ ID NO: 3), an "A" allele at rs7935393 (SEQ ID NO: 4), a "G" allele at rs12934476 (SEQ ID NO: 5), an "A" allele at rs12457255 (SEQ ID NO: 6), an "A" allele at rs2070557 (SEQ ID NO: 7), an "A" allele at rs4246905 (SEQ ID NO: 8), an "A" allele at rs10974900 (SEQ ID NO: 9), a "C" allele at rs12434976 (SEQ ID NO: 10), an "A" allele at rrs16901748 (SEQ ID NO: 11), an "A" allele at rs2815844 (SEQ ID NO: 12), a "G" allele at rs889702 (SEQ ID NO: 13), a "C" allele at rs2409750 (SEQ ID NO: 14), an "A" allele at rs1541020 (SEQ ID NO: 15), a "T" allele at rs4942248 (SEQ ID NO: 16), a "G" allele at rs12934476 (SEQ ID NO: 17), an "A" allele at rs12457255 (SEQ ID NO: 18), an "A" allele at rs2297437 (SEQ ID NO: 19), a "G" allele at rs41309367 (SEQ ID NO: 20), an "A" allele at rs10733509 (SEQ ID NO: 21), a "G" allele at rs10750376 (SEQ ID NO: 22), a "G" allele at rs10932456 (SEQ ID NO: 23), an "A" allele at rs1326860 (SEQ ID NO: 24), a "G" allele at rs1528663 (SEQ ID NO: 25), a "C" allele at rs1892231 (SEQ ID NO: 26), an "A" allele at rs951279 (SEQ ID NO: 27), an "A" allele at rs9806914 (SEQ ID NO: 28), an "A" allele at rs7935393 (SEQ ID NO: 29), a "G" allele at rs1690492 (SEQ ID NO: 30), an "A" allele at rs420726 (SEQ ID NO: 31), a "T" allele at rs7759385 (SEQ ID NO: 32), an "A" allele at rs10974900 (SEQ ID NO: 33), an "A" allele at rs1326860 (SEQ ID NO: 34), a "C" allele at rs2548147 (SEQ ID NO: 35), an "A" allele at rs2815844 (SEQ ID NO: 36), a "G" allele at rs889702 (SEQ ID NO: 37), an "A" allele at rs9806914 (SEQ ID NO: 38), an "A" allele at rs6478109 (SEQ ID NO: 39), a "C" allele at rs7278257 (SEQ ID NO: 40), an "A" allele at rs11221332 (SEQ ID NO: 41), an "A" allele at rs56124762 (SEQ ID NO: 57), a "G" at rs2070558 (SEQ ID NO: 58), and a "T" allele at rs2070561 (SEQ ID NO: 59).
21. The method of embodiments 1-20, wherein the inhibitor of TL1A activity or expression is an anti-TL1A antibody.
22. The method of embodiment 21, wherein the anti-TL1A antibody is selected from Table 2B.
23. The method of embodiment 21, wherein the anti-TL1A antibody comprises an amino acid sequence provided in Table 2A.
24. The method of embodiment 21, wherein the anti-TL1A antibody binds to the same region of human TL1A as a reference antibody selected from Table 2B.
25. The method of embodiment 21, wherein the anti-TL1A antibody binds to the same region of human TL1A as a reference antibody, the reference antibody comprising an amino acid sequence provided in Table 2A.
26. The method of embodiments 22-25, wherein the anti-TL1A antibody is a neutralizing TL1A antibody.
27. The method of embodiments 22-26, wherein the anti-TL1A antibody is an antagonist of TL1A.
28. A method of treating an inflammatory, fibrostenotic, and fibrotic, disease or condition in a subject comprising administering to the subject a therapeutically effective amount of an inhibitor of TL1A activity or expression, provided a presence of a genotype is detected in a sample obtained from the subject.
29. A method of treating an inflammatory, fibrostenotic, and fibrotic, disease or condition in a subject comprising:
   a) analyzing a sample obtained from a subject to detect a presence or an absence of a genotype;
   b) detect the presence of the genotype in the sample obtained from the subject;
   c) administering to the subject a therapeutically effective amount of an inhibitor of TL1A activity or expression.
30. The method of embodiment 28-29, provided that the inflammatory disease comprises Crohn's disease.
31. The method of embodiment 30, provided that the Crohn's disease comprises ileal, ileocolonic, or colonic Crohn's disease.
32. The method of embodiment 28-29, provided that the inflammatory disease is ulcerative colitis (UC).
33. The method of embodiment 32, provided that the UC is medically refractory UC.
34. The method of any of embodiments 29-33, wherein the presence of the genotype is detected in the sample obtained from the subject by:

a) contacting the sample comprising genetic material from the subject with a nucleic acid sequence capable of hybridizing to at least 10 contiguous nucleobases comprising a risk allele located at nucleoposition 501 within any one of SEQ ID NOS: 1-48, or 57-59; and
b) detecting binding between the nucleic acid sequence and the at least 10 contiguous nucleobases comprising the risk allele.

35. The method of embodiment 34, provided that the standard hybridization conditions comprise an annealing temperature between about 35° C. and about 65° C.

36. The method of embodiment 34 or embodiment 35, provided that the standard hybridization conditions are performed with a TaqMan master mix solution.

37. The method of any of embodiments 34-36, provided that the nucleic acid sequence is conjugated to a detectable molecule.

38. The method of embodiment 37, provided that the detectable molecule comprises a fluorophore.

39. The method of any of embodiments 34-38, provided that the nucleic acid sequence is conjugated to a quencher.

40. The method of any of embodiments 34-39, provided that the sample comprising genetic material from the subject is amplified genetic material obtained from a nucleic acid amplification assay.

41. The method of embodiment 40, provided that the nucleic acid amplification assay comprises amplification of DNA from the subject with a pair of primers capable of amplifying at least 15 contiguous nucleobases comprising the risk allele located at nucleoposition 501 within any one of SEQ ID NOS: 1-48, or 57-59, the pair of primers comprising a first primer and a second primer.

42. The method of embodiment 41, provided that the first primer comprises a nucleic acid sequence complimentary to at least 15 contiguous nucleobases upstream of the risk allele located at nucleobase 501 within any one of SEQ ID NOS: 1-48, or 57-59, and the second primer comprises a nucleic acid sequence complimentary to at least 15 contiguous nucleobases downstream of the risk allele located at nucleobase 501 within any one of SEQ ID NOS: 1-48, or 57-59.

43. The method of any of embodiments 29-42 the presence of the genotype is detected in the sample obtained from the subject by a process comprising DNA sequencing.

44. The method of any of embodiments 29-43, provided that the subject further comprises soluble TL1A at a level greater than a control level derived from a non-diseased individual or population of non-diseased individuals.

45. The method of any of embodiments 29-44, provided that the subject is homozygous for the genotype.

46. The method of any of embodiments 29-45, wherein the genotype comprises at least two polymorphisms provided in Table 1 or Table 4.

47. The method of any of embodiments 29-46, wherein the genotype comprises at least three polymorphisms provided in Table 1 or Table 4.

48. The method of any of embodiments 29-47, wherein the genotype comprises a polymorphism selected from the group consisting of a "G" allele at rs11897732 (SEQ ID NO: 1), an "A" allele at rs6740739 (SEQ ID NO: 2), a "G" allele at rs17796285 (SEQ ID NO: 3), an "A" allele at rs7935393 (SEQ ID NO: 4), a "G" allele at rs12934476 (SEQ ID NO: 5), an "A" allele at rs12457255 (SEQ ID NO: 6), an "A" allele at rs2070557 (SEQ ID NO: 7), an "A" allele at rs4246905 (SEQ ID NO: 8), an "A" allele at rs10974900 (SEQ ID NO: 9), a "C" allele at rs12434976 (SEQ ID NO: 10), an "A" allele at rrs16901748 (SEQ ID NO: 11), an "A" allele at rs2815844 (SEQ ID NO: 12), a "G" allele at rs889702 (SEQ ID NO: 13), a "C" allele at rs2409750 (SEQ ID NO: 14), an "A" allele at rs1541020 (SEQ ID NO: 15), a "T" allele at rs4942248 (SEQ ID NO: 16), a "G" allele at rs12934476 (SEQ ID NO: 17), an "A" allele at rs12457255 (SEQ ID NO: 18), an "A" allele at rs2297437 (SEQ ID NO: 19), a "G" allele at rs41309367 (SEQ ID NO: 20), an "A" allele at rs10733509 (SEQ ID NO: 21), a "G" allele at rs10750376 (SEQ ID NO: 22), a "G" allele at rs10932456 (SEQ ID NO: 23), an "A" allele at rs1326860 (SEQ ID NO: 24), a "G" allele at rs1528663 (SEQ ID NO: 25), a "C" allele at rs1892231 (SEQ ID NO: 26), an "A" allele at rs951279 (SEQ ID NO: 27), an "A" allele at rs9806914 (SEQ ID NO: 28), an "A" allele at rs7935393 (SEQ ID NO: 29), a "G" allele at rs1690492 (SEQ ID NO: 30), an "A" allele at rs420726 (SEQ ID NO: 31), a "T" allele at rs7759385 (SEQ ID NO: 32), an "A" allele at rs10974900 (SEQ ID NO: 33), an "A" allele at rs1326860 (SEQ ID NO: 34), a "C" allele at rs2548147 (SEQ ID NO: 35), an "A" allele at rs2815844 (SEQ ID NO: 36), a "G" allele at rs889702 (SEQ ID NO: 37), an "A" allele at rs9806914 (SEQ ID NO: 38), an "A" allele at rs6478109 (SEQ ID NO: 39), a "C" allele at rs7278257 (SEQ ID NO: 40), an "A" allele at rs11221332 (SEQ ID NO: 41) an "A" allele at rs56124762 (SEQ ID NO: 57), a "G" at rs2070558 (SEQ ID NO: 58), and a "T" allele at rs2070561 (SEQ ID NO: 59).

49. The method of embodiments 29-48, wherein the inhibitor of TL1A activity or expression is an anti-TL1A antibody.

50. The method of embodiment 49, wherein the anti-TL1A antibody is selected from Table 2B.

51. The method of embodiment 49, wherein the anti-TL1A antibody comprises an amino acid sequence provided in Table 2A.

52. The method of embodiment 49, wherein the anti-TL1A antibody binds to the same region of human TL1A as a reference antibody selected from Table 2B.

53. The method of embodiment 49, wherein the anti-TL1A antibody binds to the same region of human TL1A as a reference antibody, the reference antibody comprising an amino acid sequence provided in Table 2A.

54. The method of embodiments 49-53, wherein the anti-TL1A antibody is a neutralizing TL1A antibody.

55. The method of embodiments 49-54, wherein the anti-TL1A antibody is an antagonist of TL1A.

56. A method of characterizing at least one of an inflammatory, fibrostenotic, and fibrotic, disease or condition of a subject, the method comprising assaying genetic material from the subject to identify the presence or absence of a genotype comprising a polymorphism provided in Table 1 or Table 4.

57. The method of embodiment 56, further comprising assigning a more favorable prognosis to treatment with an inhibitor of TL1A activity or expression when the genotype is present.

58. The method of embodiment 56, further comprising assigning a less favorable prognosis to with an inhibitor of TL1A activity or expression when the genotype is absent.

59. The method of embodiment 56, further comprising assigning the subject to treatment with an inhibitor of TL1A activity or expression when the genotype is present.

60. The method of embodiment 56, further comprising prescribing to the subject an inhibitor of TL1A activity or expression when the genotype is present.

61. The method of embodiment 56, further comprising administering to the subject an inhibitor of anti-CD30 ligand activity or expression when the genotype is present.
62. The method of any of embodiments 57-61, provided that the inhibitor of TL1A activity or expression is an anti-TL1A antibody or antigen-binding fragment thereof
63. The method of any of embodiments 56-62, provided that assaying comprises amplifying from the genetic material comprising at least 15 contiguous nucleobases including a risk allele located at nucleoposition 501 within any one of SEQ ID NOS: 1-48, or 57-59 using a pair of primers comprising a first primer and a second primer.
64. The method of any of embodiment 63, provided that the first primer comprises a nucleic acid sequence complimentary to at least 15 contiguous nucleobases upstream of the risk allele located at nucleobase 501 within any one of SEQ ID NOS: 1-48, or 57-59, and the second primer comprises a nucleic acid sequence complimentary to at least 15 contiguous nucleobases downstream of the risk allele located at nucleobase501 within any one of SEQ ID NOS: 1-48, or 57-59.
65. The method of any of embodiments 65-73, provided that assaying comprises hybridizing to the genetic material a nucleic acid comprising any one of SEQ ID NOS: 1-48, or 57-59.
66. The method of embodiment 65, provided that the nucleic acid sequence is conjugated to a detectable molecule.
67. The method of embodiment 66, provided that the detectable molecule comprises a fluorophore.
68. The method of any of embodiments 65-67, provided that the nucleic acid sequence is conjugated to a quencher.
69. The method of any of embodiments 56-62, provided that assaying comprises DNA sequencing.
70. The method of any of embodiments 56-69, further comprising measuring the level of TL1A in the subject.
71. The method of any of embodiments 56-70, provided that the subject is homozygous for the genotype.
72. The method of embodiments 56-71, wherein the genotype comprises at least two polymorphisms provided in Table 1 or Table 4.
73. The method of any of embodiments 56-72, wherein the genotype comprises at least three polymorphisms provided in Table 1 or Table 4
74. The method of any one of embodiments 56-73, wherein the genotype comprises at least one polymorphism comprising a non-reference allele.
75. The method of any of embodiments 56-74, further comprising characterizing the at least one of the inflammatory, the fibrostenotic, and the fibrotic, disease or condition as Crohn's disease (CD) provided the genotype is present.
76. The method of embodiment 75, provided that the CD comprises ileal, ileocolonic, or colonic CD.
77. The method of any of embodiments 56-76, further comprising characterizing the at least one of the inflammatory, the fibrostenotic, and the fibrotic, disease or condition as a ulcerative colitis (UC), provided the genotype is present.
78. The method of embodiment 77, provided that the fibrotic disease is medically refractory UC.
79. The method of embodiment 62, wherein the anti-TL1A antibody is selected from Table 2B.
80. The method of embodiment 62, wherein the anti-TL1A antibody comprises an amino acid sequence provided in Table 2A.
81. The method of embodiment 62, wherein the anti-TL1A antibody binds to the same region of human TL1A as a reference antibody selected from Table 2B.
82. The method of embodiment 62, wherein the anti-TL1A antibody binds to the same region of human TL1A as a reference antibody, the reference antibody comprising an amino acid sequence provided in Table 2A.
83. The method of embodiments 79-82, wherein the anti-TL1A antibody is a neutralizing TL1A antibody.
84. The method of embodiments 79-83, wherein the anti-TL1A antibody is an antagonist of TL1A.
85. A method for detecting a genotype of interest in a subject comprising at least one of an inflammatory, a fibrostenotic, and a fibrotic, disease or condition, the method comprising:
   (a) contacting genetic material from the subject with a composition sufficiently complementary to and capable of hybridizing to the genotype of interest, the composition comprising:
      (i) a detectably labeled oligonucleotide probe comprising at least 10 contiguous nucleobases provided in any one of SEQ ID NOS: 1-48, or 57-59,
      (ii) a detectably labeled oligonucleotide probe comprising at least 10 contiguous nucleobases provided in any one of SEQ ID NOS: 1-48, or 57-59,
      (iii) a detectably labeled oligonucleotide probe comprising at least 10 contiguous nucleobases provided in any one of SEQ ID NOS: 1-48, or 57-59,
      (iv) a detectably labeled oligonucleotide probe comprising a nucleic acid sequence that differs from a probe selected from the group consisting of (i)-(iii) by up to three nucleobases, provided the detectably labeled oligonucleotide probe of (iv) hybridizes to the genotype of interest,
      (v) a detectably labeled oligonucleotide probe comprising a nucleic acid sequence complementary to a probe selected from the group consisting of (i)-(iv), or
      (vi) a combination of probes selected from the group consisting of (i)-(v), wherein the detectably labeled oligonucleotide probe of (i), (ii), and (iii) are different,
   (b) detecting the presence or absence of hybridization of the genetic material with the composition using the detectably labeled probe, whereby hybridization of the genetic material with the composition is indicative of the presence of the genotype of interest in the subject.
86. The method of embodiment 85, provided that the presence of the genotype of interest is indicative of the subject comprising elevated levels of TL1A.
87. The method of embodiment 85 or embodiment 86, provided that the inflammatory disease comprises Crohn's disease (CD).
88. The method of embodiment 87, provided that the CD comprises ileal, ileocolonic, or colonic CD.
89. The method of any of embodiments 89-92, provided that the inflammatory disease is ulcerative colitis (UC).
90. A method of treating the at least one of an inflammatory disease, a fibrostenotic disease, in the subject of any one of embodiments 85-89, the method comprising:
   a) administering to the subject of any of embodiments 85-93 a therapeutically effective amount of an inhibitor of TL1A activity or expression, provided that the subject comprises the genotype of interest.
91. The method of embodiment 90, provided that the inhibitor of TL1A activity comprises an anti-TL1A ligand antibody or antigen binding fragment thereof.

92. A composition comprising at least 10 but less than 50 contiguous nucleobase residues of any one of SEQ ID NOS: 1-48, or 57-59 or its complement, wherein the contiguous nucleobase residues comprise the nucleobase at position 501 of the any one of SEQ ID NOS: 1-48, or 57-59, and wherein the contiguous nucleobase residues are connected to a detectable molecule.
93. The composition of embodiment 92, provided that the detectable molecule is a fluorophore.
94. The composition of embodiments 92-93, wherein the contiguous nucleobase residues comprise the nucleobase at position 501 of any one of SEQ ID NOS: 1-48, or 57-59.
95. The composition of embodiments 92-93, wherein the contiguous nucleobase residues comprise the nucleobase at position 501 of any one of SEQ ID NOS: 60-108, or 364141-364142.
96. The composition of embodiments 92-95, provided that the contiguous nucleobase residues are connected to a quencher.
97. A kit comprising the composition of any of embodiments 92-96, and a primer pair capable of amplifying at least 15 contiguous nucleic acid molecules of any one of SEQ ID NOS: 1-48, or 57-59, the at least 15 contiguous nucleic acid molecules comprising the nucleic acid located at position 501 of any one of SEQ ID NOS: 1-48, or 57-59.
98. A method comprising contacting DNA from a subject with the composition of any of embodiments 92-96 or the kit of any of embodiment 97 under conditions configured to hybridize the composition to the DNA if the DNA comprises a sequence complementary to the composition.
99. A method comprising treating the subject of embodiment 98 with an inhibitor of TL1A activity or expression, provided that the DNA from the subject comprises the sequence complementary to the composition.
100. The method of embodiment 99, provided that the inhibitor of TL1A comprises an anti-TL1A antibody or antigen binding fragment thereof.
101. A method of identifying a risk of developing a TL1A mediated disease or condition comprising at least one of an inflammatory, a fibrostenotic, and a fibrotic, disease or condition in a subject, the method comprising:
   a) assaying a sample obtained from the subject to identify the presence of a genotype comprising a polymorphism provided in Table 1 or Table 4, or a polymorphism in linkage disequilibrium (LD) therewith; and
   b) identifying the risk of developing at least one of an inflammatory, a fibrostenotic, and a fibrotic, disease or condition in the subject, provided the presence of the genotype is identified in step (a).
102. A method of selecting a subject for treatment, the method comprising:
   a) assaying a sample obtained from the subject to identify the presence of a genotype comprising a polymorphism provided in Table 1 or Table 4, or a polymorphism in linkage disequilibrium (LD) therewith; and
   b) selecting the subject for treatment with an inhibitor of TL1A activity or expression, provided the presence of the genotype is identified in step (a).
103. The method of any of embodiments 101-102, provided that the subject is homozygous for the genotype.
104. The method of any of embodiments 101-103, wherein the genotype comprises at least two polymorphisms provided in Table 1 or Table 4.
105. The method of any of embodiments 101-104, wherein the genotype comprises at least three polymorphisms provided in Table 1 or Table 4.
106. The method of any of embodiments 101-105, wherein the genotype comprises at least one polymorphism comprising a non-reference allele.
107. The method of any of embodiments 101-106, further comprising treating the subject by administering to the subject a therapeutically effective amount of an inhibitor of TL1A activity or expression.
108. The method of embodiment 107, wherein the inhibitor of TL1A activity or expression is an anti-TL1A antibody.
109. The method of embodiment 108, wherein the anti-TL1A antibody is selected from Table 2B.
110. The method of embodiment 108, wherein the anti-TL1A antibody comprises an amino acid sequence provided in Table 2A.
111. The method of embodiment 108, wherein the anti-TL1A antibody binds to the same region of human TL1A as a reference antibody selected from Table 2B.
112. The method of embodiment 108, wherein the anti-TL1A antibody binds to the same region of human TL1A as a reference antibody, the reference antibody comprising an amino acid sequence provided in Table 2A.
113. The method of embodiments 108-112, wherein the anti-TL1A antibody is a neutralizing TL1A antibody.
114. The method of embodiments 108-113, wherein the anti-TL1A antibody is an antagonist of TL1A.
115. The methods of embodiments 28-55 or 101-106, further comprising administering a therapeutically effective amount of an additional therapeutic agent.
116. The method of embodiment 115, wherein the additional therapeutic agent is a modulator of Receptor Interacting Serine/Threonine Kinase 2 (RIPK2).
117. The method of embodiment 115, wherein the additional therapeutic agent is a modulator of G Protein-Coupled Receptor 35 (GPR35).
118. The method of embodiment 115, wherein the additional therapeutic agent is a modulator of CD30 ligand (CD30L)
119. The method of embodiment 16, wherein the modulator of RIPK2 is selected from the group consisting of Formula I-X.
120. The method of embodiment 117, wherein the modulator of GPR35 is selected from the group consisting of Formula I-XXVI.
121. The method of embodiment 118, wherein the modulator of CD30L comprises an amino acid sequence provided in Table 3.
122. The method of any one of embodiments 1-121, further comprising predicting a positive therapeutic response in a subject to a treatment with the inhibitor of TL1A activity or expression with a positive predictive value of at least or about 50%, 55%, 60%, 65%, 70%, 75%, 80%, 85%, 90%, 91%, 92%, 93%, 94% 95%, 96%, 97%, 98%, 99%, or 100%.
123. The method of any one of embodiments 1-122, further comprising predicting a positive therapeutic response in a subject to a treatment with the inhibitor of TL1A activity or expression with a specificity of at least or about 50%, 55%, 60%, 65%, 70%, 75%, 80%, 85%, 90%, 91%, 92%, 93%, 94% 95%, 96%, 97%, 98%, 99%, or 100%.

Kits and Compositions

Compositions

Disclosed herein are compositions useful for the detection of a genotype or biomarker in a sample obtained from a subject according to the methods described herein. Aspects disclosed herein provide compositions comprises a polynucleotide sequence comprising at least 10 but less than 50 contiguous nucleotides of any one of SEQ ID NOS: 1-48, or 57-59, or reverse complements thereof, wherein the contiguous polynucleotide sequence comprises a detectable molecule. In some embodiments, the polynucleotide sequence comprises the nucleobase at a nucleoposition indicated by the non-nucleic acid letter (e.g., S, R, V) in any one of SEQ ID NOS: 1-48, or 57-59. In various embodiments, the detectable molecule comprises a fluorophore. In other embodiments, the polynucleotide sequences further comprise a quencher.

Also disclosed herein are compositions comprising an antibody or antigen-binding fragment that specifically binds to a target protein described herein (e.g., TL1A) wherein the antibody or antigen-binding fragment comprises a detectable molecule. In various embodiments, the antibody comprises a monoclonal antibody, a chimeric antibody, a CDR-grafted antibody, a Fab, a Fab', a F(ab')2, a Fv, a disulfide linked Fv, a scFv, a single domain antibody, a diabody, a multispecific antibody, a dual specific antibody, an anti-idiotypic antibody, or a bispecific antibody. In some embodiments, the antibody or antigen-binding fragment comprises an IgG antibody, an IgM antibody, and/or an IgE antibody. In some embodiments, the detectable molecule comprises a fluorophore. In some embodiments, the antibody or antigen-binding fragment is conjugated to a paramagnetic particle (e.g., bead).

Kits

Disclosed herein, are kits useful for to detect the genotypes and/or biomarkers disclosed herein. In some embodiments, the kits disclosed herein may be used to diagnose and/or treat a disease or condition in a subject; or select a patient for treatment and/or monitor a treatment disclosed herein. In some embodiments, the kit comprises the compositions described herein, which can be used to perform the methods described herein. Kits comprise an assemblage of materials or components, including at least one of the compositions. Thus, in some embodiments the kit contains a composition including of the pharmaceutical composition, for the treatment of IBD. In other embodiments, the kits contains all of the components necessary and/or sufficient to perform an assay for detecting and measuring IBD markers, including all controls, directions for performing assays, and any necessary software for analysis and presentation of results.

In some instances, the kits described herein comprise components for detecting the presence, absence, and/or quantity of a target nucleic acid and/or protein described herein. In some embodiments, the kit further comprises components for detecting the presence, absence, and/or quantity of a serological marker described herein. In some embodiments, the kit comprises the compositions (e.g., primers, probes, antibodies) described herein. The disclosure provides kits suitable for assays such as enzyme-linked immunosorbent assay (ELISA), single-molecular array (Simoa), PCR, and qPCR. The exact nature of the components configured in the kit depends on its intended purpose.

In some embodiments, the kits described herein are configured for the purpose of treating and/or characterizing a disease or condition (e.g., Crohn's disease), or subclinical phenotype thereof (e.g., stricturing, penetrating, or stricturing and penetrating disease phenotypes) in a subject. In some embodiments, the kits described herein are configured for the purpose of identifying a subject suitable for treatment with an inhibitor of TL1A activity or expression (e.g., anti-TL1A antibody). In some embodiments, the kit is configured particularly for the purpose of treating mammalian subjects. In some embodiments, the kit is configured particularly for the purpose of treating human subjects. In further embodiments, the kit is configured for veterinary applications, treating subjects such as, but not limited to, farm animals, domestic animals, and laboratory animals. In some embodiments, the kit is configured to select a subject for a therapeutic agent, such as those disclosed herein. In some embodiments, the kit is configured to select a subject for treatment with a therapeutic agent disclosed herein. An exemplary therapeutic agent is an anti-TL1A antibody.

Instructions for use may be included in the kit. Optionally, the kit also contains other useful components, such as, diluents, buffers, pharmaceutically acceptable carriers, syringes, catheters, applicators, pipetting or measuring tools, bandaging materials or other useful paraphernalia. The materials or components assembled in the kit can be provided to the practitioner stored in any convenient and suitable ways that preserve their operability and utility. For example the components can be in dissolved, dehydrated, or lyophilized form; they can be provided at room, refrigerated or frozen temperatures. The components are typically contained in suitable packaging material(s). As employed herein, the phrase "packaging material" refers to one or more physical structures used to house the contents of the kit, such as compositions and the like. The packaging material is constructed by well-known methods, preferably to provide a sterile, contaminant-free environment. The packaging materials employed in the kit are those customarily utilized in gene expression assays and in the administration of treatments. As used herein, the term "package" refers to a suitable solid matrix or material such as glass, plastic, paper, foil, and the like, capable of holding the individual kit components. Thus, for example, a package can be a glass vial or prefilled syringes used to contain suitable quantities of the pharmaceutical composition. The packaging material has an external label which indicates the contents and/or purpose of the kit and its components.

Systems

Figure 2:
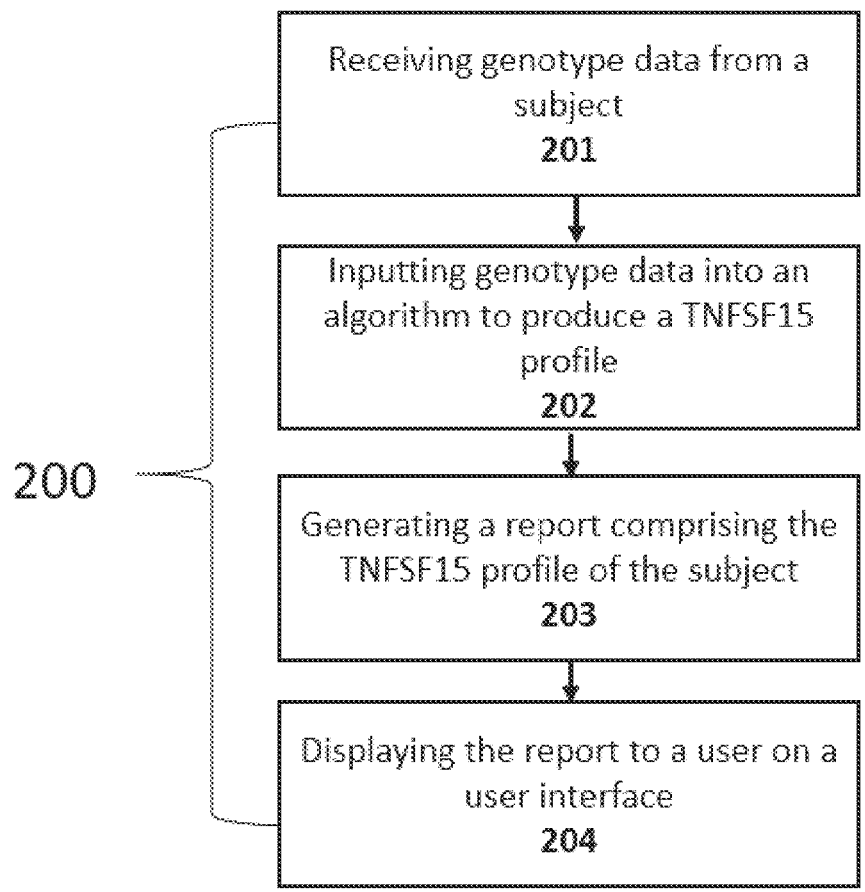
FIG. 2 shows a computer-implemented workflow according to an embodiment of the present disclosure for generating an electronic report to a user, such as a physician, comprising a TNFSF15 profile of a subject based on an analysis of genotype data from the subject.

Disclosed herein are systems for identifying a subject as being suitable for treatment with an inhibitor of TL1A activity or expression (e.g., anti-TL1A antibody). In some embodiments, the systems described herein comprise kits and compositions for detecting the genotypes described herein in a biological sample of a subject. The system may comprise a computer system for implementing one or more methods of the disclosure, such as for example, receiving genotype data of a subject 201, inputting the genotype data into an algorithm to produce a TNFSF15 profile 202, and generating a report comprising the TNFSF15 profile of the subject 203, and displaying the report to a user on a graphical user interface 204, as shown in FIG. 2. A "TNFSF15 profile" as used herein refers to a profile of expression of one or more genotypes described herein in a subject that is detected in a biological sample obtained from the subject. In some embodiments, a TNFSF15 profile comprises a positive, a negative, or an indeterminate result (e.g., therapeutic response to treatment with an inhibitor of TL1A activity or expression).

Computer Systems

Figure 3:
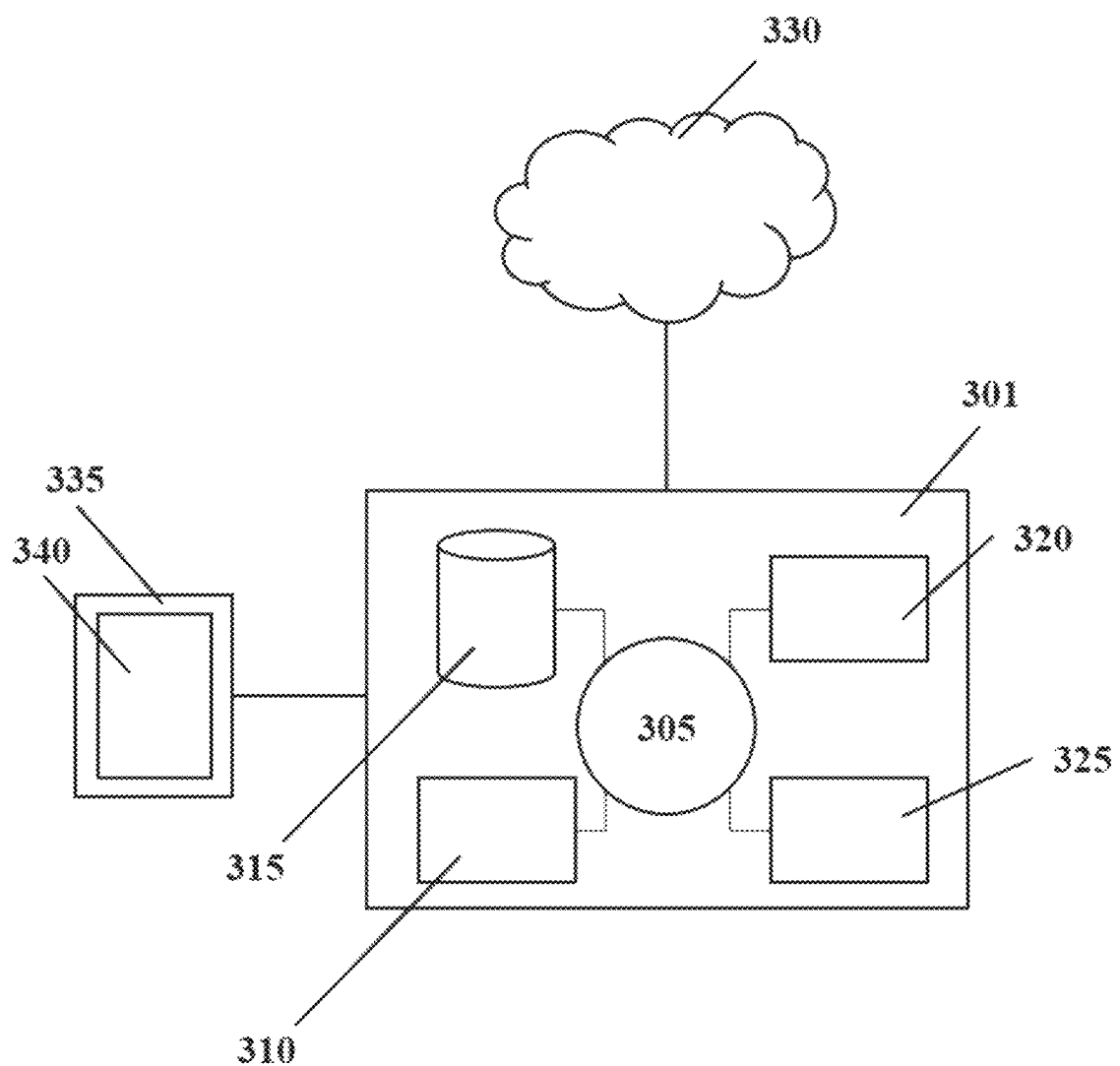
FIG. 3 shows a computer system that is programmed or otherwise configured to implement methods provided herein.

FIG. 3 shows a computer system 301 that is programmed or otherwise configured to generate a TNFSF15 profile for a subject in need thereof. The computer system 301 can regulate various aspects of producing the TNFSF15 profile (e.g., receiving genotype data, generating a report with the TNFSF15 profile of the biological sample, and displaying the report to a user), of the present disclosure, such as, for example, by including permissions or encryption of genotype data and/or TNFSF15 profile of the subject to ensure patient privacy.

The computer system 301 can be an electronic device of a user or a computer system that is remotely located with respect to the electronic device. The electronic device can be a mobile electronic device, such as a mobile electronic device belonging to a physician.

The computer system 301 includes a central processing unit (CPU, also "processor" and "computer processor" herein) 305, which can be a single core or multi core processor, or a plurality of processors for parallel processing. The computer system 301 also includes memory or memory location 310 (e.g., random-access memory, read-only memory, flash memory), electronic storage unit 315 (e.g., hard disk), communication interface 320 (e.g., network adapter) for communicating with one or more other systems, and peripheral devices 325, such as cache, other memory, data storage and/or electronic display adapters. The memory 310, storage unit 315, interface 320 and peripheral devices 325 are in communication with the CPU 305 through a communication bus (solid lines), such as a motherboard. The storage unit 315 can be a data storage unit (or data repository) for storing data. The computer system 301 can be operatively coupled to a computer network ("network") 330 with the aid of the communication interface 320. The network 330 can be the Internet, an internet and/or extranet, or an intranet and/or extranet that is in communication with the Internet. The network 330 in some cases is a telecommunication and/or data network. The network 330 can include one or more computer servers, which can enable distributed computing, such as cloud computing. The network 330, in some cases with the aid of the computer system 301, can implement a peer-to-peer network, which may enable devices coupled to the computer system 301 to behave as a client or a server.

The CPU 305 can execute a sequence of machine-readable instructions, which can be embodied in a program or software. The instructions may be stored in a memory location, such as the memory 310. The instructions can be directed to the CPU 305, which can subsequently program or otherwise configure the CPU 305 to implement methods of the present disclosure. Examples of operations performed by the CPU 305 can include fetch, decode, execute, and writeback.

The CPU 305 can be part of a circuit, such as an integrated circuit. One or more other components of the system 301 can be included in the circuit. In some cases, the circuit is an application specific integrated circuit (ASIC).

The storage unit 315 can store files, such as drivers, libraries and saved programs. The storage unit 315 can store user data, e.g., user preferences and user programs. The computer system 301 in some cases can include one or more additional data storage units that are external to the computer system 301, such as located on a remote server that is in communication with the computer system 301 through an intranet or the Internet.

The computer system 301 can communicate with one or more remote computer systems through the network 330. For instance, the computer system 301 can communicate with a remote computer system of a user. Examples of remote computer systems include personal computers (e.g., portable PC), slate or tablet PC's (e.g., Apple® iPad, Samsung® Galaxy Tab), telephones, Smart phones (e.g., Apple® iPhone, Android-enabled device, Blackberry®), or personal digital assistants. The user can access the computer system 301 via the network 330.

Methods as described herein can be implemented by way of machine (e.g., computer processor) executable code stored on an electronic storage location of the computer system 301, such as, for example, on the memory 310 or electronic storage unit 315. The machine executable or machine readable code can be provided in the form of software. During use, the code can be executed by the processor 305. In some cases, the code can be retrieved from the storage unit 315 and stored on the memory 310 for ready access by the processor 305. In some situations, the electronic storage unit 315 can be precluded, and machine-executable instructions are stored on memory 310.

The code can be pre-compiled and configured for use with a machine having a processer adapted to execute the code, or can be compiled during runtime. The code can be supplied in a programming language that can be selected to enable the code to execute in a pre-compiled or as-compiled fashion.

Aspects of the systems and methods provided herein, such as the computer system 301, can be embodied in programming. Various aspects of the technology may be thought of as "products" or "articles of manufacture" typically in the form of machine (or processor) executable code and/or associated data that is carried on or embodied in a type of machine readable medium. Machine-executable code can be stored on an electronic storage unit, such as memory (e.g., read-only memory, random-access memory, flash memory) or a hard disk. "Storage" type media can include any or all of the tangible memory of the computers, processors or the like, or associated modules thereof, such as various semiconductor memories, tape drives, disk drives and the like, which may provide non-transitory storage at any time for the software programming. All or portions of the software may at times be communicated through the Internet or various other telecommunication networks. Such communications, for example, may enable loading of the software from one computer or processor into another, for example, from a management server or host computer into the computer platform of an application server. Thus, another type of media that may bear the software elements includes optical, electrical and electromagnetic waves, such as used across physical interfaces between local devices, through wired and optical landline networks and over various air-links. The physical elements that carry such waves, such as wired or wireless links, optical links or the like, also may be considered as media bearing the software. As used herein, unless restricted to non-transitory, tangible "storage" media, terms such as computer or machine "readable medium" refer to any medium that participates in providing instructions to a processor for execution.

Hence, a machine readable medium, such as computer-executable code, may take many forms, including but not limited to, a tangible storage medium, a carrier wave medium or physical transmission medium. Non-volatile storage media include, for example, optical or magnetic disks, such as any of the storage devices in any computer(s) or the like, such as may be used to implement the databases, etc. shown in the drawings. Volatile storage media include dynamic memory, such as main memory of such a computer platform. Tangible transmission media include coaxial cables; copper wire and fiber optics, including the wires that comprise a bus within a computer system. Carrier-wave transmission media may take the form of electric or electromagnetic signals, or acoustic or light waves such as those generated during radio frequency (RF) and infrared (IR) data communications. Common forms of computer-readable media therefore include for example: a floppy disk, a flexible disk, hard disk, magnetic tape, any other magnetic medium, a CD-ROM, DVD or DVD-ROM, any other optical medium, punch cards paper tape, any other physical storage medium with patterns of holes, a RAM, a ROM, a PROM and EPROM, a FLASH-EPROM, any other memory chip or cartridge, a carrier wave transporting data or instructions, cables or links transporting such a carrier wave, or any other medium from which a computer may read programming code and/or data. Many of these forms of computer readable media may be involved in carrying one or more sequences of one or more instructions to a processor for execution.

The computer system 301 can include or be in communication with an electronic display 335 that comprises a user interface (UI) 340 for providing, for example, a report comprising the TNFSF15 profile of the subject or other relevant clinical information for purposes of informing a selection of a therapeutic agent (e.g., anti-TL1A antibody) to treat a disease or condition of the subject described herein. Examples of UFs include, without limitation, a graphical user interface (GUI) and web-based user interface.

Figure 4:
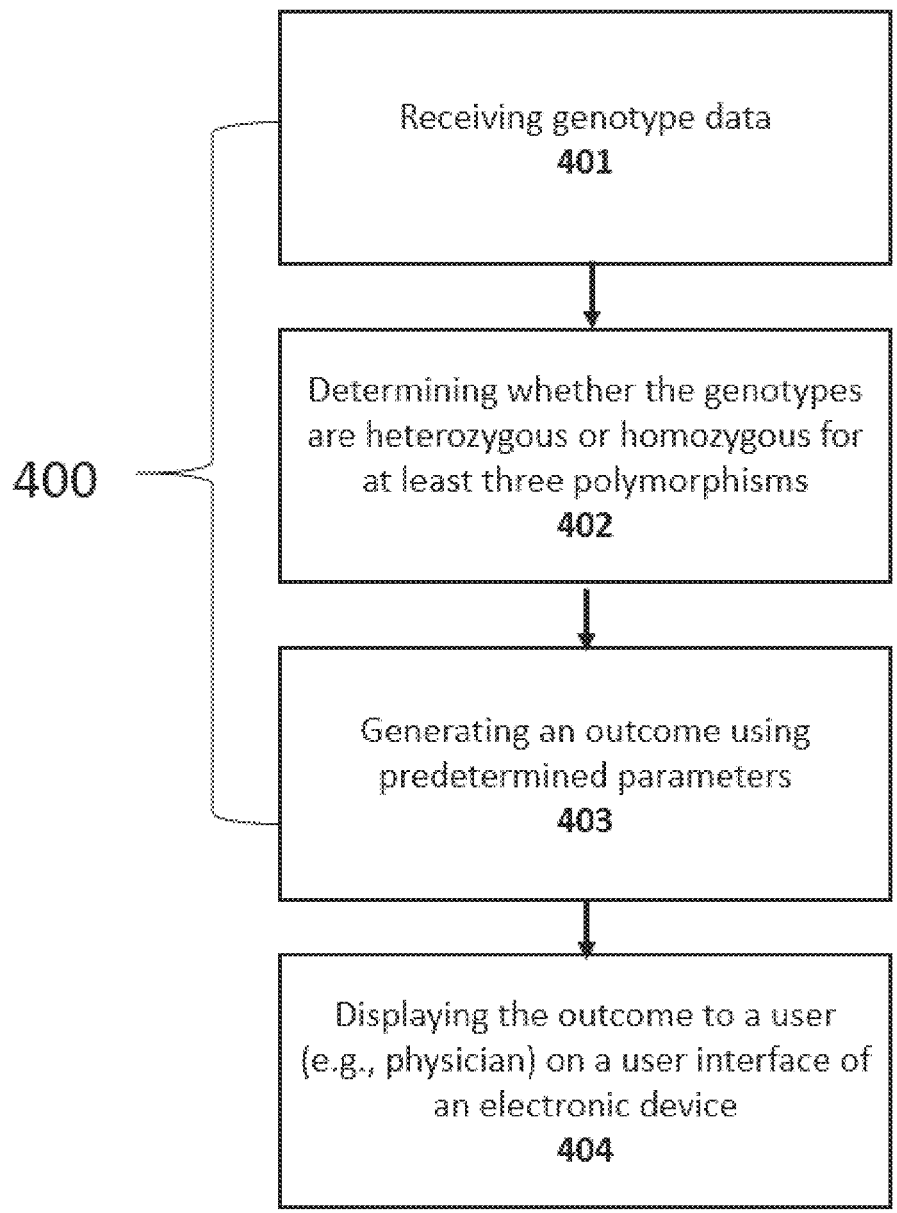
FIG. 4 shows a computer-implemented workflow according to an embodiment of the present disclosure for producing a TNFSF15 profile.

Methods and systems of the present disclosure can be implemented by way of one or more algorithms. An algorithm can be implemented by way of software upon execution by the central processing unit 305. The algorithm can, for example, perform: (a) receiving genotype data of a subject 401, (b) determining whether the genotypes are heterozygous or homozygous for at least three polymorphisms 402, (c) generating an outcome using predetermined parameters 403, and (d) displaying the outcome to a user (e.g., physician) on a user interface of an electronic device 404, as shown in FIG. 4. In some embodiments, the outcome is positive, negative or indeterminant. In some embodiments, the predetermined parameters are genotype combinations known to be predictive of a therapeutic response to a treatment, such as with an inhibitor of TL1A activity or expression.

Web Application

In some embodiments, the computer system comprises software for a web application. In light of the disclosure provided herein, those of skill in the art will recognize that a web application may utilize one or more software frameworks and one or more database systems. A web application, for example, is created upon a software framework such as Microsoft® .NET or Ruby on Rails (RoR). A web application, in some instances, utilizes one or more database systems including, by way of non-limiting examples, relational, non-relational, feature oriented, associative, and XML database systems. Suitable relational database systems include, by way of non-limiting examples, Microsoft® SQL Server, mySQL™, and Oracle®. Those of skill in the art will also recognize that a web application may be written in one or more versions of one or more languages. In some embodiments, a web application is written in one or more markup languages, presentation definition languages, client-side scripting languages, server-side coding languages, database query languages, or combinations thereof. In some embodiments, a web application is written to some extent in a markup language such as Hypertext Markup Language (HTML), Extensible Hypertext Markup Language (XHTML), or eXtensible Markup Language (XML). In some embodiments, a web application is written to some extent in a presentation definition language such as Cascading Style Sheets (CSS). In some embodiments, a web application is written to some extent in a client-side scripting language such as Asynchronous Javascript and XML (AJAX), Flash® Actionscript, Javascript, or Silverlight®. In some embodiments, a web application is written to some extent in a server-side coding language such as Active Server Pages (ASP), ColdFusion®, Perl, Java™, JavaServer Pages (JSP), Hypertext Preprocessor (PHP), Python™, Ruby, Tcl, Smalltalk, WebDNA®, or Groovy. In some embodiments, a web application is written to some extent in a database query language such as Structured Query Language (SQL). A web application may integrate enterprise server products such as IBM® Lotus Domino®. A web application may include a media player element. A media player element may utilize one or more of many suitable multimedia technologies including, by way of non-limiting examples, Adobe® Flash®, HTML 5, Apple® QuickTime®, Microsoft® Silverlight®, Java™, and Unity®.

Mobile Application

In some embodiments, the computer system comprises software for a mobile application. The mobile application may be provided to a mobile digital processing device at the time it is manufactured. The mobile application may be provided to a mobile digital processing device via the computer network described herein.

A mobile application is created by techniques known to those of skill in the art using hardware, languages, and development environments known to the art. Those of skill in the art will recognize that mobile applications may be written in several languages. Suitable programming languages include, by way of non-limiting examples, C, C++, C #, Featureive-C, Java™, Javascript, Pascal, Feature Pascal, Python™, Ruby, VB.NET, WML, and XHTML/HTML with or without CSS, or combinations thereof.

Suitable mobile application development environments are available from several sources. Commercially available development environments include, by way of non-limiting examples, AirplaySDK, alcheMo, Appcelerator®, Celsius, Bedrock, Flash Lite, .NET Compact Framework, Rhomobile, and WorkLight Mobile Platform. Other development environments may be available without cost including, by way of non-limiting examples, Lazarus, MobiFlex, MoSync, and Phonegap. Also, mobile device manufacturers distribute software developer kits including, by way of non-limiting examples, iPhone and iPad (iOS) SDK, Android™ SDK, BlackBerry® SDK, BREW SDK, Palm® OS SDK, Symbian SDK, webOS SDK, and Windows® Mobile SDK.

Those of skill in the art will recognize that several commercial forums are available for distribution of mobile applications including, by way of non-limiting examples, Apple® App Store, Android™ Market, BlackBerry® App World, App Store for Palm devices, App Catalog for webOS, Windows® Marketplace for Mobile, Ovi Store for Nokia® devices, Samsung® Apps, and Nintendo® DSi Shop.

Standalone Application

In some embodiments, the computer system comprises software a standalone application, which is a program that may be run as an independent computer process, not an add-on to an existing process, e.g., not a plug-in. Those of skill in the art will recognize that standalone applications are sometimes compiled. In some instances, a compiler is a computer program(s) that transforms source code written in a programming language into binary feature code such as assembly language or machine code. Suitable compiled programming languages include, by way of non-limiting examples, C, C++, Featureive-C, COBOL, Delphi, Eiffel, Java™, Lisp, Python™, Visual Basic, and VB .NET, or combinations thereof. Compilation may be often performed, at least in part, to create an executable program. In some instances, a computer program includes one or more executable complied applications.

Web Browser Plug-in

In some embodiments, the computer system comprises software that comprises a web browser plug-in. In computing, a plug-in, in some instances, is one or more software components that add specific functionality to a larger software application. Makers of software applications may support plug-ins to enable third-party developers to create abilities which extend an application, to support easily adding new features, and to reduce the size of an application. When supported, plug-ins enable customizing the functionality of a software application. For example, plug-ins are commonly used in web browsers to play video, generate interactivity, scan for viruses, and display particular file types. Those of skill in the art will be familiar with several web browser plug-ins including, Adobe® Flash® Player, Microsoft® Silverlight®, and Apple® QuickTime®. The toolbar may comprise one or more web browser extensions, add-ins, or add-ons. The toolbar may comprise one or more explorer bars, tool bands, or desk bands.

In view of the disclosure provided herein, those of skill in the art will recognize that several plug-in frameworks are available that enable development of plug-ins in various programming languages, including, by way of non-limiting examples, C++, Delphi, Java™, PHP, Python™, and VB .NET, or combinations thereof.

In some embodiments, Web browsers (also called Internet browsers) are software applications, designed for use with network-connected digital processing devices, for retrieving, presenting, and traversing information resources on the World Wide Web. Suitable web browsers include, by way of non-limiting examples, Microsoft® Internet Explorer®, Mozilla® Firefox®, Google® Chrome, Apple® Safari®, Opera Software® Opera®, and KDE Konqueror. The web browser, in some instances, is a mobile web browser. Mobile web browsers (also called microbrowsers, mini-browsers, and wireless browsers) may be designed for use on mobile digital processing devices including, by way of non-limiting examples, handheld computers, tablet computers, netbook computers, subnotebook computers, smartphones, music players, personal digital assistants (PDAs), and handheld video game systems. Suitable mobile web browsers include, by way of non-limiting examples, Google® Android® browser, RIM BlackBerry® Browser, Apple® Safari®, Palm® Blazer, Palm® WebOS® Browser, Mozilla® Firefox® for mobile, Microsoft® Internet Explorer® Mobile, Amazon® Kindle® Basic Web, Nokia® Browser, Opera Software® Opera® Mobile, and Sony® PSP™ browser.

Software Modules

The medium, method, and system disclosed herein comprise one or more softwares, servers, and database modules, or use of the same. In view of the disclosure provided herein, software modules may be created by techniques known to those of skill in the art using machines, software, and languages known to the art. The software modules disclosed herein may be implemented in a multitude of ways. In some embodiments, a software module comprises a file, a section of code, a programming feature, a programming structure, or combinations thereof. A software module may comprise a plurality of files, a plurality of sections of code, a plurality of programming features, a plurality of programming structures, or combinations thereof. By way of non-limiting examples, the one or more software modules comprise a web application, a mobile application, and/or a standalone application. Software modules may be in one computer program or application. Software modules may be in more than one computer program or application. Software modules may be hosted on one machine. Software modules may be hosted on more than one machine. Software modules may be hosted on cloud computing platforms. Software modules may be hosted on one or more machines in one location. Software modules may be hosted on one or more machines in more than one location.

Databases

The medium, method, and system disclosed herein comprise one or more databases, or use of the same. In view of the disclosure provided herein, those of skill in the art will recognize that many databases are suitable for storage and retrieval of geologic profile, operator activities, division of interest, and/or contact information of royalty owners. Suitable databases include, by way of non-limiting examples, relational databases, non-relational databases, feature oriented databases, feature databases, entity-relationship model databases, associative databases, and XML, databases. In some embodiments, a database is internet-based. In some embodiments, a database is web-based. In some embodiments, a database is cloud computing-based. A database may be based on one or more local computer storage devices.

Data Transmission

The subject matter described herein, including methods for producing a TNFSF15 profile are configured to be performed in one or more facilities at one or more locations. Facility locations are not limited by country and include any country or territory. In some instances, one or more steps are performed in a different country than another step of the method. In some instances, one or more steps for obtaining a sample are performed in a different country than one or more steps for detecting the presence or absence of a genotype in a biological sample. In some embodiments, one or more method steps involving a computer system are performed in a different country than another step of the methods provided herein. In some embodiments, data processing and analyses are performed in a different country or location than one or more steps of the methods described herein. In some embodiments, one or more articles, products, or data are transferred from one or more of the facilities to one or more different facilities for analysis or further analysis. An article includes, but is not limited to, one or more components obtained from a subject, e.g., processed cellular material. Processed cellular material includes, but is not limited to, cDNA reverse transcribed from RNA, amplified RNA, amplified cDNA, sequenced DNA, isolated and/or purified RNA, isolated and/or purified DNA, and isolated and/or purified polypeptide. Data includes, but is not limited to, information regarding the stratification of a subject, and any data produced by the methods disclosed herein. In some embodiments of the methods and systems described herein, the analysis is performed and a subsequent data transmission step will convey or transmit the results of the analysis.

In some embodiments, any step of any method described herein is performed by a software program or module on a computer. In additional or further embodiments, data from any step of any method described herein is transferred to and from facilities located within the same or different countries, including analysis performed in one facility in a particular location and the data shipped to another location or directly to an individual in the same or a different country. In additional or further embodiments, data from any step of any method described herein is transferred to and/or received from a facility located within the same or different countries, including analysis of a data input, such as genetic or processed cellular material, performed in one facility in a particular location and corresponding data transmitted to another location, or directly to an individual, such as data related to the diagnosis, prognosis, responsiveness to therapy (e.g., anti-TL1A therapy), or the like, in the same or different location or country.

Business Methods Utilizing a Computer

The methods described herein may utilize one or more computers. The computer may be used for managing customer and biological sample information such as sample or customer tracking, database management, analyzing molecular profiling data, analyzing cytological data, storing data, billing, marketing, reporting results, storing results, or a combination thereof. The computer may include a monitor or other user interface for displaying data, results, billing information, marketing information (e.g. demographics), customer information, or sample information. The computer may also include means for data or information input. The computer may include a processing unit and fixed or removable media or a combination thereof. The computer may be accessed by a user in physical proximity to the computer, for example via a keyboard and/or mouse, or by a user that does not necessarily have access to the physical computer through a communication medium such as a modem, an internet connection, a telephone connection, or a wired or wireless communication signal carrier wave. In some cases, the computer may be connected to a server or other communication device for relaying information from a user to the computer or from the computer to a user. In some cases, the user may store data or information obtained from the computer through a communication medium on media, such as removable media. It is envisioned that data relating to the methods can be transmitted over such networks or connections for reception and/or review by a party. The receiving party can be but is not limited to an individual, a health care provider (e.g., physician) or a health care manager. In one embodiment, a computer-readable medium includes a medium suitable for transmission of a result of an analysis of a biological sample, such as exosome bio-signatures. The medium can include a result regarding an exosome bio-signature of a subject, wherein such a result is derived using the methods described herein.

The entity obtaining a report with the TNFSF15 profile may enter biological sample information into a database for the purpose of one or more of the following: inventory tracking, assay result tracking, order tracking, customer management, customer service, billing, and sales. Sample information may include, but is not limited to: customer name, unique customer identification, customer associated medical professional, indicated assay or assays, assay results, adequacy status, indicated adequacy tests, medical history of the individual, preliminary diagnosis, suspected diagnosis, sample history, insurance provider, medical provider, third party testing center or any information suitable for storage in a database. Sample history may include but is not limited to: age of the sample, type of sample, method of acquisition, method of storage, or method of transport.

The database may be accessible by a customer, medical professional, insurance provider, or other third party. Database access may take the form of electronic communication such as a computer or telephone. The database may be accessed through an intermediary such as a customer service representative, business representative, consultant, independent testing center, or medical professional. The availability or degree of database access or sample information, such as assay results, may change upon payment of a fee for products and services rendered or to be rendered. The degree of database access or sample information may be restricted to comply with generally accepted or legal requirements for patient or customer confidentiality.

II. Exemplary Embodiments

Among the exemplary embodiments are:
1. A computer system for evaluating a sample from a subject, the system comprising:

a) a central computing environment;
b) an input device operatively connected to said central computing environment, wherein said input device is configured to receive a presence or absence of a genotype that correlates with a disease state in the sample;
c) a trained algorithm executed by said central computing environment, wherein the trained algorithm is configured to use the presence or absence of the genotype to classify said sample as at least one of (i) a disease or normal sample, and (ii) a response or a non-response to an anti-TL1A therapy; and
d) an output device operatively connected to said central computing environment, wherein said output device is configured to provide information on the classification to a user.

2. The computer system of embodiment 1, wherein the disease state comprises at least one of an inflammatory, a fibrostenotic, and a fibrotic, disease or condition.

3. The computer system of embodiment 1 or embodiment 2, wherein the disease state is a TL1A mediated disease state selected from the group consisting of inflammatory bowel disease (IBD), Crohn's disease (CD), obstructive CD, ulcerative colitis (UC), intestinal fibrosis, intestinal fibrostenosis, rheumatoid arthritis, and primary sclerosing cholangitis.

4. The computer system of any previous embodiment, wherein the sample comprises whole blood, plasma, serum, or tissue.

5. The computer system of any previous embodiment, wherein the genotype comprises at least one polymorphism selected from Table 1 or Table 4, a polymorphism in linkage disequilibrium (LD) therewith, and any combination thereof 6. The computer system of any previous embodiment, wherein the genotype comprises at least one polymorphism comprising a non-reference allele.

7. The computer system of any previous embodiment, wherein the genotype comprises at least two polymorphisms provided in Table 1 or Table 4.

8. The computer system of any previous embodiment, wherein the genotype comprises at least three polymorphisms provided in Table 1 or Table 4.

9. The computer system of any previous embodiment, further comprising the genotype is homozygous.

10. The computer system of embodiment 5-9, where LD is defined by an $r^2$ value of at least 0.80, 0.85, 0.90, 0.95, or 1.0.

11. The computer system of any previous embodiment, wherein the genotype is associated with a risk that a subject has, or will develop, the disease state by a P value of at most about $1.0 \times 10^{-6}$, about $1.0 \times 10^{-7}$, about $1.0 \times 10^{-8}$, about $1.0 \times 10^{-9}$, about $1.0 \times 10^{-10}$, about $1.0 \times 10^{-20}$, about $1.0 \times 10^{-30}$, about $1.0 \times 10^{-40}$, about $1.0 \times 10^{-50}$, about $1.0 \times 10^{-60}$, about $1.0 \times 10^{-70}$, about $1.0 \times 10^{-80}$, about $1.0 \times 10^{-90}$, or about $1.0 \times 10^{-100}$.

12. The computer system of any previous embodiment, wherein said output device provides a report summarizing said information on said classification.

13. The computer system of any previous embodiment, wherein said report comprises a recommendation for treatment of said disease state.

14. The computer system of embodiment 13, wherein the treatment comprises administration of an inhibitor of TL1A activity or expression.

15. The computer system of embodiment 14, wherein the inhibitor of TL1A activity or expression comprises an antibody or antigen-binding fragment, peptide, or small molecule.
16. The computer system of any preceding embodiment, wherein said genotype is determined with an assay comprising polymerase chain reaction (PCR), quantitative reverse-transcription PCR (qPCR), automated sequencing, genotype array, or a combination thereof.
17. Use of a composition comprising one or more binding agents for generating a report that classifies a sample from a subject as at least one of (i) a disease or non-disease state and (ii) a response or a non-response to an anti-TL1A therapy, wherein the one or more binding agents specifically bind to a risk allele provided in Table 1 corresponding to a polymorphism provided in Table 1, their compliment, a polymorphism in linkage disequilibrium therewith, and any combination thereof.
18. The use of embodiment 17, wherein generating the report further comprises:
    a) providing the sample from the subject;
    b) assaying the sample from the subject for detecting the presence of the risk allele corresponding to the polymorphism provided in Table 1;
    c) generating the report based on the result of step (b); and
    d) determining whether said subject has or is likely to exhibit a positive therapeutic response to a treatment with an inhibitor of TL1A activity or expression based on the results of step (b).
19. The use of embodiment 17 or 18, wherein the disease state comprises at least one of an inflammatory, a fibrostenotic, and a fibrotic, disease or condition.
20. The use of embodiment 17-19, wherein the disease state is a TL1A-mediated disease state selected from the group consisting of inflammatory bowel disease (IBD), Crohn's disease (CD), obstructive CD, ulcerative colitis (UC), intestinal fibrosis, intestinal fibrostenosis, and primary sclerosing cholangitis.
21. The use of any of embodiments 17-20, wherein the sample comprises whole blood, plasma, serum, or tissue.
22. The use of embodiment 18, wherein assaying the sample from the subject for detecting the presence of the risk allele corresponding to the polymorphism provided in Table 1 of step (b) comprises:
    a) contacting the sample with the one or more binding agents that specifically bind to at least 10 contiguous nucleobases that includes the risk allele provided in any one of SEQ ID NOS: 1-41, or 57-59; and
    b) determining whether the sample specifically binds to said one or more binding agents, wherein binding of the sample to the one or more binding agents indicates the presence of the polymorphism in the subject.
23. The use of embodiment 18, wherein assaying the sample from the subject for detecting the presence of the risk allele corresponding to the polymorphism provided in Table 1 of step (b) comprises sequencing of the sample.
24. The use of embodiment 18, wherein assaying the sample from the subject for detecting the presence of the one or more polymorphisms of step (b) comprises quantifying the amount of DNA comprising the risk allele.
25. The use of embodiment 24, wherein the quantifying comprises PCR.
26. The use of embodiment 25, wherein the PCR comprises real-time PCR.
27. The use of embodiment 24, wherein the quantifying comprises hybridization.
28. A composition comprising one or more binding agents that specifically bind to a risk allele corresponding to a polymorphism provided in Table 1, wherein the one or more binding agents are selected to classify a sample as at least one of (i) a disease or non-disease or a disease state and (ii) a response or a non-response to an anti-TL1A therapy.
29. The composition of embodiment 28, wherein the one or more binding agents comprise oligonucleotides.
30. The composition of embodiment 29, wherein the oligonucleotides comprise RNA or DNA.
31. The composition of embodiment 29, wherein the one or more binding agents comprise aptamers, antibodies, peptide nucleic acids, or pyranosyl RNA.
32. A kit for detecting at least one of an inflammatory, a fibrostenotic, and a fibrotic, disease or condition in a subject, the kit comprising:
    a) at least one binding agent that specifically binds to at least 10 contiguous nucleic acid molecules provided in any one of SEQ ID NOS: 1-41, or 57-59 including a corresponding risk allele provided in Table 1, or their complement, wherein the at least one binding agent is selected to detect at least one of (i) a disease or non-disease state and (ii) a response or a non-response to an anti-TL1A therapy; and
    b) reagents for detecting binding of said at least one binding agent to a DNA sample from a subject.
33. The kit of embodiment 32, wherein the at least one binding agent comprises at least one oligonucleotide.
34. The kit of embodiment 32, wherein the at least one binding agent comprises at least one aptamer, antibody, peptide nucleic acid, or pyranosyl RNA.
35. The kit of embodiment 32-34, wherein the at least one binding agent is labelled with a detectable label.
36. The kit of embodiment 32-35 wherein the at least one binding agent is immobilized to a surface.
37. A system for generating a report that classifies a sample a disease or non-disease of a disease state, comprising:
    a) a computer system that:
        i. generates a molecular profile of a DNA sample based upon the presence of at least one polymorphism, or their complement; and
        ii. generates a report that classifies the sample based on said molecular profile; and
    b) a computer screen that displays said report.
38. The system of embodiment 37, wherein the presence of the at least one polymorphism is based on the result of an assay of said DNA sample, which result is entered into a database.
39. The system of embodiment 37-38, further comprising an input for said result.
40. The system of claim 37-39, wherein the at least one polymorphism is selected from Table 1.
41. The system of claim 37-41, wherein the at least one polymorphism comprises a non-reference allele.
42. The system of claim 41, wherein the at least one polymorphism is two polymorphisms.
43. The system of claim 41, wherein the at least one polymorphism is three polymorphisms.
44. Use of a composition comprising an inhibitor of TL1A for treating a subject, provided the subject is a carrier of a genotype comprising a polymorphism provided in Table 1 or Table 4.
45. The use of embodiment 44, wherein the inhibitor of TL1A activity or expression is an anti-TL1A antibody.
46. The use of embodiment 45, wherein the anti-TL1A antibody is selected from Table 2B.

47. The use of embodiment 45, wherein the anti-TL1A antibody comprises an amino acid sequence provided in Table 2A.
48. The use of embodiment 45, wherein the anti-TL1A antibody binds to the same region of human TL1A as a reference antibody selected from Table 2B.
49. The use of embodiment 45, wherein the anti-TL1A antibody binds to the same region of human TL1A as a reference antibody, the reference antibody comprising an amino acid sequence provided in Table 2A.
50. The use of embodiments 45-49, wherein the anti-TL1A antibody is a neutralizing TL1A antibody.
51. The use of embodiments 45-49, wherein the anti-TL1A antibody is an antagonist of TL1A.
52. The use of embodiments 44-51, wherein the genotype comprises at least two polymorphisms provided in Table 2 or Table 4.
53. The use of embodiments 44-51, wherein the genotype comprises at least three polymorphisms provided in Table 2 or Table 4.
54. The method of use of embodiments 44-53, wherein the genotype comprises at least one polymorphism comprising a non-reference allele.
55. The computer system of embodiments 1-16, wherein said trained algorithm is configured to classify said sample as a positive therapeutic response to the anti-TL1A therapy with a positive predictive value of at least or about 50%, 55%, 60%, 65%, 70%, 75%, 80%, 85%, 90%, 91%, 92%, 93%, 94% 95%, 96%, 97%, 98%, 99%, or 100%.
56. The computer system of embodiments 1-16, wherein said trained algorithm is configured to classify said sample as a positive therapeutic response to the anti-TL1A therapy with a specificity of at least or about 50%, 55%, 60%, 65%, 70%, 75%, 80%, 85%, 90%, 91%, 92%, 93%, 94% 95%, 96%, 97%, 98%, 99%, or 100%.
57. The use of embodiments 17-27, wherein the report classifies the sample as a positive therapeutic response to the anti-TL1A therapy with a positive predictive value of at least or about 50%, 55%, 60%, 65%, 70%, 75%, 80%, 85%, 90%, 91%, 92%, 93%, 94% 95%, 96%, 97%, 98%, 99%, or 100%.
58. The use of embodiments 17-27, wherein the report classifies the sample as a positive therapeutic response to the anti-TL1A therapy with a specificity of at least or about 50%, 55%, 60%, 65%, 70%, 75%, 80%, 85%, 90%, 91%, 92%, 93%, 94% 95%, 96%, 97%, 98%, 99%, or 100%.
59. The system of embodiments 37-43, wherein the report that classifies the sample based on said molecular profile as positive for a therapeutic response to a treatment with an anti-TL1A therapy with a positive predictive value of at least or about 50%, 55%, 60%, 65%, 70%, 75%, 80%, 85%, 90%, 91%, 92%, 93%, 94% 95%, 96%, 97%, 98%, 99%, or 100%.
60. The system of embodiments 37-43, wherein the report that classifies the sample based on said molecular profile as positive for a therapeutic response to a treatment with an anti-TL1A therapy with a specificity of at least or about 50%, 55%, 60%, 65%, 70%, 75%, 80%, 85%, 90%, 91%, 92%, 93%, 94% 95%, 96%, 97%, 98%, 99%, or 100%.

Definitions

Unless defined otherwise, all terms of art, notations and other technical and scientific terms or terminology used herein are intended to have the same meaning as is commonly understood by one of ordinary skill in the art to which the claimed subject matter pertains. In some cases, terms with commonly understood meanings are defined herein for clarity and/or for ready reference, and the inclusion of such definitions herein should not necessarily be construed to represent a substantial difference over what is generally understood in the art.

Throughout this application, various embodiments may be presented in a range format. It should be understood that the description in range format is merely for convenience and brevity and should not be construed as an inflexible limitation on the scope of the disclosure. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

As used in the specification and claims, the singular forms "a", "an" and "the" include plural references unless the context clearly dictates otherwise. For example, the term "a sample" includes a plurality of samples, including mixtures thereof.

The terms "determining," "measuring," "evaluating," "assessing," "assaying," and "analyzing" are often used interchangeably herein to refer to forms of measurement. The terms include determining if an element is present or not (for example, detection). These terms can include quantitative, qualitative or quantitative and qualitative determinations. Assessing can be relative or absolute. "Detecting the presence of" can include determining the amount of something present in addition to determining whether it is present or absent depending on the context.

The term "in vivo" is used to describe an event that takes place in a subject's body.

The term "ex vivo" is used to describe an event that takes place outside of a subject's body. An ex vivo assay is not performed on a subject. Rather, it is performed upon a sample separate from a subject. An example of an ex vivo assay performed on a sample is an "in vitro" assay.

The term "in vitro" is used to describe an event that takes places contained in a container for holding laboratory reagent such that it is separated from the biological source from which the material is obtained. In vitro assays can encompass cell-based assays in which living or dead cells are employed. In vitro assays can also encompass a cell-free assay in which no intact cells are employed.

As used herein, the term "about" a number refers to that number plus or minus 10% of that number. The term "about" a range refers to that range minus 10% of its lowest value and plus 10% of its greatest value.

As used herein, the terms "homologous," "homology," or "percent homology" when used herein to describe to an amino acid sequence or a nucleic acid sequence, relative to a reference sequence, can be determined using the formula described by Karlin and Altschul (Proc. Natl. Acad. Sci. USA 87: 2264-2268, 1990, modified as in Proc. Natl. Acad. Sci. USA 90:5873-5877, 1993). Such a formula is incorporated into the basic local alignment search tool (BLAST) programs of Altschul et al. (J Mol Biol. 1990 Oct. 5; 215(3):403-10; Nucleic Acids Res. 1997 Sep. 1; 25(17): 3389-402). Percent homology of sequences can be determined using the most recent version of BLAST, as of the filing date of this application. Percent identity of sequences can be determined using the most recent version of BLAST, as of the filing date of this application.

The terms "increased," or "increase" are used herein to generally mean an increase by a statically significant amount. In some embodiments, the terms "increased," or "increase," mean an increase of at least 10% as compared to a reference level, for example an increase of at least about 10%, at least about 20%, or at least about 30%, or at least about 40%, or at least about 50%, or at least about 60%, or at least about 70%, or at least about 80%, or at least about 90% or up to and including a 100% increase or any increase between 10-100% as compared to a reference level, standard, or control. Other examples of "increase" include an increase of at least 2-fold, at least 5-fold, at least 10-fold, at least 20-fold, at least 50-fold, at least 100-fold, at least 1000-fold or more as compared to a reference level. An increase can be an absolute amount (e.g., level of protein expression), or a rate of production (e.g., rate of protein expression between two points in time).

The terms, "decreased" or "decrease" are used herein generally to mean a decrease by a statistically significant amount. In some embodiments, "decreased" or "decrease" means a reduction by at least 10% as compared to a reference level, for example a decrease by at least about 20%, or at least about 30%, or at least about 40%, or at least about 50%, or at least about 60%, or at least about 70%, or at least about 80%, or at least about 90% or up to and including a 100% decrease (e.g., absent level or non-detectable level as compared to a reference level), or any decrease between 10-100% as compared to a reference level. In the context of a marker or symptom, by these terms is meant a statistically significant decrease in such level. The decrease can be, for example, at least 10%, at least 20%, at least 30%, at least 40% or more, and is preferably down to a level accepted as within the range of normal for an individual without a given disease.

The terms "subject" encompass mammals. Non-limiting examples of mammal include, any member of the mammalian class: humans, non-human primates such as chimpanzees, and other apes and monkey species; farm animals such as cattle, horses, sheep, goats, swine; domestic animals such as rabbits, dogs, and cats; laboratory animals including rodents, such as rats, mice and guinea pigs, and the like. In one aspect, the mammal is a human. The term "animal" as used herein comprises human beings and non-human animals. In one embodiment, a "non-human animal" is a mammal, for example a rodent such as rat or a mouse. In some instances, a human subject is a "patient," which as used herein, refers to a subject who may be diagnosed with a disease or condition disclosed herein.

The term "gene," as used herein, refers to a segment of nucleic acid that encodes an individual protein or RNA (also referred to as a "coding sequence" or "coding region"), optionally together with associated regulatory region such as promoter, operator, terminator and the like, which may be located upstream or downstream of the coding sequence. A "genetic locus" referred to herein, is a particular location within a gene.

The term, "genotype" as disclosed herein, refers to the chemical composition of polynucleotide sequences within the genome of an individual. In some embodiments, the genotype comprises a single nucleotide polymorphism (SNP) or and indel (insertion or deletion, of a nucleobase within a polynucleotide sequence). In some embodiments, a genotype for a particular SNP, or indel is heterozygous. In some embodiments, a genotype for a particular SNP, or indel is homozygous.

A "polymorphism" as used herein refers to an aberration in (e.g., a mutation), or of (e.g., insertion/deletion), a nucleic acid sequence, as compared to the nucleic acid sequence in a reference population. In some embodiments, the polymorphism is common in the reference population. In some embodiments, the polymorphism is rare in the reference population. In some embodiments, the polymorphism is a single nucleotide polymorphism.

The term, "single nucleotide polymorphism" or SNP as disclosed herein, refers to a variation in a single nucleotide within a polynucleotide sequence. The term should not be interpreted as placing a restriction on a frequency of the SNP in a given population. The variation of an SNP may have multiple different forms. A single form of an SNP is referred to as an "allele." An SNP can be mono-, bi-, tri, or tetra-allelic. A SNP may include a "risk allele," a "protective allele," or neither. By way of example, a reference polynucleotide sequence reading 5' to 3' is TTACG. A SNP at allele position 3 (of 5'-TTACG-3') comprise a substitution of the reference allele, "A" to a non-reference allele, "C." If the "C" allele of the SNP is associated with an increased probability of developing a phenotypic trait, the allele is considered a "risk" allele. However, the same SNP may also comprise a substitution of the "A" allele to a "T" allele at position 3. If the T allele of the SNP is associated with a decreased probability of developing a phenotypic trait, the allele is considered a "protective" allele. The SNP may be observed in at least 1% of a given population. In some embodiments, the SNP is represented by an "rs" number, which refers to the accession of reference cluster of one more submitted SNPs in the dbSNP bioinformatics database as of the filing date of this patent application, and which is included within a sequence that comprises the total number of nucleobases from 5' to 3'. In some embodiments, a SNP may be further defined by the position of the SNP (nucleobase) within the db SNP sequence, the position of which is always with reference to 5' length of the sequence plus 1. In some embodiments, a SNP is defined as the genomic position in a reference genome and the allele change (e.g. chromosome 7 at position 234,123,567 from G allele to A allele in the reference human genome build 37). In some embodiments, the SNV is defined as the genomic position identified with [brackets] or an "N" in a sequence disclosed herein.

The term, "indel," as disclosed herein, refers to an insertion, or a deletion, of a nucleobase within a polynucleotide sequence. An indel can be mono-, bi-, tri, or tetra-allelic. An indel may be "risk," a "protective," or neither, for a phenotypic trait. In some embodiments, the indel is represented by an "rs" number, which refers to the accession of reference cluster of one more submitted indels in the dbSNP bioinformatics database as of the filing date of this patent application, and which is included in a sequence that comprises the total number of nucleobases from 5' to 3'. In some embodiments, an indel may be further defined by the position of the insertion/deletion within the db SNP sequence, the position of which is always with reference to the 5' length of the sequence plus 1. In some embodiments, an indel is defined as the genomic position in a reference genome and the allele change. In some embodiments, the indel is defined as the genomic position identified with [brackets] or an "N" in a sequence disclosed herein.

"Haplotype" as used herein, encompasses a group of one or more genotypes, which tend to be inherited together in a reference population. In some embodiments, a haplotype comprises particular polymorphism or another polymorphism in linkage disequilibrium (LD) therewith.

"Linkage disequilibrium," or "LD," as used herein refers to the non-random association of alleles or indels in different gene loci in a given population. LD may be defined by a D' value corresponding to the difference between an observed and expected allele or indel frequencies in the population (D=Pab-PaPb), which is scaled by the theoretical maximum value of D. LD may be defined by an $r^2$ value corresponding to the difference between an observed and expected unit of risk frequencies in the population (D=Pab-PaPb), which is scaled by the individual frequencies of the different loci. In some embodiments, D' comprises at least 0.20. In some embodiments, $r^2$ comprises at least 0.70.

The term "medically refractory," or "refractory," as used herein, refers to the failure of a standard treatment to induce remission of a disease. In some embodiments, the disease comprises an inflammatory disease disclosed herein. A non-limiting example of refractory inflammatory disease includes refractory Crohn's disease, and refractory ulcerative colitis (e.g., mrUC). Non-limiting examples of standard treatment include glucocorticosteriods, anti-TNF therapy, anti-a4-b7 therapy (vedolizumab), anti-IL12p40 therapy (ustekinumab), Thalidomide, and Cytoxin.

The terms "treat," "treating," and "treatment" as used herein refers to alleviating or abrogating a disorder, disease, or condition; or one or more of the symptoms associated with the disorder, disease, or condition; or alleviating or eradicating a cause of the disorder, disease, or condition itself. Desirable effects of treatment can include, but are not limited to, preventing occurrence or recurrence of disease, alleviation of symptoms, diminishing any direct or indirect pathological consequences of the disease, preventing metastasis, decreasing the rate of disease progression, amelioration or palliation of the disease state and remission or improved prognosis.

The term "therapeutically effective amount" refers to the amount of a compound or therapy that, when administered, is sufficient to prevent development of, or alleviate to some extent, one or more of the symptoms of a disorder, disease, or condition of the disease; or the amount of a compound that is sufficient to elicit biological or medical response of a cell, tissue, system, animal, or human that is being sought by a researcher, veterinarian, medical doctor, or clinician.

The term "pharmaceutically acceptable carrier," "pharmaceutically acceptable excipient," "physiologically acceptable carrier," or "physiologically acceptable excipient" refers to a pharmaceutically-acceptable material, composition, or vehicle, such as a liquid or solid filler, diluent, excipient, solvent, or encapsulating material. A component can be "pharmaceutically acceptable" in the sense of being compatible with the other ingredients of a pharmaceutical formulation. It can also be suitable for use in contact with the tissue or organ of humans and animals without excessive toxicity, irritation, allergic response, immunogenicity, or other problems or complications, commensurate with a reasonable benefit/risk ratio. See, Remington: The Science and Practice of Pharmacy, 21st Edition; Lippincott Williams & Wilkins: Philadelphia, Pa., 2005; Handbook of Pharmaceutical Excipients, 5th Edition; Rowe et al., Eds., The Pharmaceutical Press and the American Pharmaceutical Association: 2005; and Handbook of Pharmaceutical Additives, 3rd Edition; Ash and Ash Eds., Gower Publishing Company: 2007; Pharmaceutical Preformulation and Formulation, Gibson Ed., CRC Press LLC: Boca Raton, Fla., 2004).

The term "pharmaceutical composition" refers to a mixture of a compound disclosed herein with other chemical components, such as diluents or carriers. The pharmaceutical composition can facilitate administration of the compound to an organism. Multiple techniques of administering a compound exist in the art including, but not limited to, oral, injection, aerosol, parenteral, and topical administration.

The term "inflammatory bowel disease" or "IBD" as used herein refers to gastrointestinal disorders of the gastrointestinal tract. Non-limiting examples of IBD include, Crohn's disease (CD), ulcerative colitis (UC), indeterminate colitis (IC), microscopic colitis, diversion colitis, Behcet's disease, and other inconclusive forms of IBD. In some instances, IBD comprises fibrosis, fibrostenosis, stricturing and/or penetrating disease, obstructive disease, or a disease that is refractory (e.g., mrUC, refractory CD), perianal CD, or other complicated forms of IBD.

Non-limiting examples of "sample" include any material from which nucleic acids and/or proteins can be obtained. As non-limiting examples, this includes whole blood, peripheral blood, plasma, serum, saliva, mucus, urine, semen, lymph, fecal extract, cheek swab, cells or other bodily fluid or tissue, including but not limited to tissue obtained through surgical biopsy or surgical resection. In various embodiments, the sample comprises tissue from the large and/or small intestine. In various embodiments, the large intestine sample comprises the cecum, colon (the ascending colon, the transverse colon, the descending colon, and the sigmoid colon), rectum and/or the anal canal. In some embodiments, the small intestine sample comprises the duodenum, jejunum, and/or the ileum. Alternatively, a sample can be obtained through primary patient derived cell lines, or archived patient samples in the form of preserved samples, or fresh frozen samples.

The term "biomarker" comprises a measurable substance in a subject whose presence, level, or activity, is indicative of a phenomenon (e.g., phenotypic expression or activity; disease, condition, subclinical phenotype of a disease or condition, infection; or environmental stimuli). In some embodiments, a biomarker comprises a gene, gene expression product (e.g., RNA or protein), or a cell-type (e.g., immune cell).

The term "serological marker," as used herein refers to a type of biomarker representing an antigenic response in a subject that may be detected in the serum of the subject. In some embodiments, a serological comprises an antibody against various fungal antigens. Non-limiting examples of a serological marker comprise anti-*Saccharomyces cerevisiae* antibody (ASCA), an anti-neutrophil cytoplasmic antibody (ANCA), *E. coli* outer membrane porin protein C (OmpC), anti-*Malassezia restricta* antibody, anti-*Malassezia pachydermatis* antibody, anti-*Malassezia furfur* antibody, anti-*Malassezia globasa* antibody, anti-*Cladosporium albicans* antibody, anti-laminaribiose antibody (ALCA), anti-chitobioside antibody (ACCA), anti-laminarin antibody, anti-chitin antibody, pANCA antibody, anit-I2 antibody, and anti-Cbir1 flagellin antibody.

The term "microbiome" and its variation used herein describe the populations and interactions of the bacteria, fungi, protists, and virus that align the gastrointestinal tract of a subject. A subject afflicted with IBD may possess presence, absence, excess, diminished, or a combination thereof of a microbiome s compared to a healthy subject.

The terms "non-response," or "loss-of-response," as used herein, refer to phenomena in which a subject or a patient does not respond to the induction of a standard treatment (e.g., anti-TNF therapy), or experiences a loss of response to the standard treatment after a successful induction of the therapy. The induction of the standard treatment may include 1, 2, 3, 4, or 5, doses of the therapy. A "successful induction" of the therapy may be an initial therapeutic response or benefit provided by the therapy. The loss of response may be characterized by a reappearance of symptoms consistent with a flare after a successful induction of the therapy.

The section headings used herein are for organizational purposes only and are not to be construed as limiting the subject matter described.

EXAMPLES

The following examples are included for illustrative purposes only and are not intended to limit the scope of the invention.

Example 1: Overview of the Identification of Genotypes

Tumor Necrosis Factor (Ligand) Superfamily, Member 15 (TNFSF15) has been determined to be significantly associated with inflammatory bowel disease (IBD), including Crohn's disease (CD), by Genome Wide Association Studies (GWAS) (e.g., cases versus controls). In addition, increased levels of TL1A (e.g., RNA and protein) are associated with IBD, including CD. Therefore, therapeutic strategies targeting TNFSF15 (TL1A) expression or activity offer a promising approach for the treatment of IBD. Disclosed herein is the identification of polymorphisms that are associated with, and therefore predictive of, an increase in TNFSF15 (TL1A) expression in patients with IBD, including CD, using a machine learning approach.

A polygenic risk score (PRS) adapted to identify individuals at risk for having increased TNFSF15 (TL1A) was applied to a cohort of CD patients recruited at the Cedars-Sinai Medical Center. A machine learning algorithm (e.g., XGBoost) was used to identify combinations of polymorphisms associated with increased TNFSF15 (TL1A) expression or activity. The resulting 41 polymorphisms, and a possible combinations of polymorphisms, have optimal prediction precision across multiple iterations of training the machine learning algorithm, which was able to analyze large combinations of polymorphism interactions (e.g., including non-linear interactions) in an efficient manner, which traditional GWAS methodologies cannot achieve. The resulting polymorphisms are useful for selecting a subject, who may or may not be diagnosed with IBD, who may exhibit a therapeutic response to an TNFSF15 (TL1A)-targeting therapeutic agent (e.g., neutralizing anti-TL1A antibody).

Example 2: Calculation of TNFSF15 PRS

A polygenic risk score (PRS) based on polymorphisms within multiple genes of interest (e.g., involved in the TL1A-mediated inflammatory pathways) and their associated weights in each respective reference population was calculated. The PRS is referred to herein as the "TNFSF15 PRS." The polymorphisms were selected from multiple GWAS based on a defined distances from the transcription start and stop sites for the gene(s) of interest (e.g., 250 kilobases upstream and downstream). Each GWAS was to define the individual weights for contribution of a polymorphism to the total score. The GWAS used include, but are not limited to, Jostins et al., 2012. Nature. 491:119-124, Liu et al., 2015. Nat Genet. 47:979-986, Ellinghaus et al., 2016. Nat Genet. 48:510-518, Huang et al., 2017. Nat Genet. 49:256-261, and de Lange et al., 2017. Nat Genet. 48:256-261.

To confirm the relevance of inclusion of a polymorphism within the TNFSF15 PRS, the polymorphisms were cross-checked by (i) evidence of cis-QTL, where the SNP is directly associated with target gene expression in tissues and (ii) sensitivity analysis, where selected polymorphisms are removed from the TNFSF15 PRS and a regression analysis is run against disease susceptibility and subclinical phenotypes, thus highlighting relevant polymorphisms to disease risk. In some cases, the polymorphisms were subjected to sensitivity analysis, and in other cases, they were not. For example, in some cases, only those polymorphisms with questionable association to the pathway TNFSF15 PRS (e.g., no eQTL or multiple genes within the loci) are subjected to sensitivity analysis.

Patients with Crohn's disease (CD) were recruited. The diagnosis of each patient was based on standard endoscopic, histologic, and radiographic features. Blood samples were collected from patients at the time of enrollment. Genotyping was performed using Immunochip (ICHIP) per manufacturer's protocol on all samples collected.

A TNFSF15 PRS was calculated for Caucasian patients within a Cedars-Sinai CD cohort from Example 1, based on the defined set of polymorphisms selected in this Example 2, which are provided in Table 4. An exemplary calculation of TNFSF15 PRS is outlined in Li et al., 2018. Inflamm Bowel Dis. 12; 24(11):2413-2422. The TNFSF15 PRS is calculated as the weighted sum of the number of risk alleles carried by each patient (in the Cedars-Sinai CD cohort) (0, 1, or 2) at each loci for the genes described in this Example 2, divided by a total number of genetic variants used in the model. The same calculations were performed for each individual belonging to a reference group, thereby generating a range of raw scores (observed range). The resulting TNFSF15 PRS is generated by comparing the score of each patient with the observed range observed in the reference group.

TABLE 4

TNFSF15 Polygenic Risk Score (PRS) Polymorphisms

| rsID | Illumina_id | Minor Allele | Minor Allele Frequency | Major Allele | Chromosome | Gene | Seq ID No. |
|---|---|---|---|---|---|---|---|
| rs11221332 | imm_11_127_886184 | A | 0.232475 | G | chr11 | ETS1 | 41 |
| rs7134599 | imm_12_667_86342 | A | 0.381954 | G | chr12 | IFNG | 42 |
| rs6062496 | imm_20_617_99543 | G | 0.406514 | A | chr20 | TNFRSF6B | 43 |
| rs4246905 | imm_9_1165_93070 | A | 0.270925 | G | chr9 | TNFSF15 | 8 |
| rs7468800 | imm_9_1166_31826 | A | 0.124622 | C | chr9 | TNFSF15; TNFSF8 | 44 |
| rs1569328 | rs1569328 | A | 0.14869 | G | chr14 | U2; FOS | 45 |
| rs2284553 | rs2284553 | A | 0.386244 | G | chr21 | IFNGR2 | 46 |
| rs6062504 | rs6062504 | A | 0.27128 | G | chr20 | ZGPAT | 47 |
| rs7556897 | rs7556897 | G | 0.334936 | A | chr2 | SLC19A3: CCL20 | 48 |

Example 3: XGBoost Machine Learning Algorithm Trained on Binary Classifiers Based on TNFSF15 Polygenic Risk Score A binary classifier to be used in the XGBoost machine learning platform for CD samples was created based on the distribution of the TNFSF15 PRS scores (calculated in Example 2) across the CD cohort. In this example, patient samples from the CD cohort were classified as 0 if their TNFSF15 PRS was ≤25th percentile of the TNFSF15 PRS CD distribution. Patient samples were classified as 1 if their TNFSF15 PRS was ≥75th percentile of the TNFSF15 PRS CD distribution.

Once the initial classifier of TNFSF15 SNPs was established, the XGBoost algorithm was optimized for the polymorphisms and implemented to generate an initial list of candidate polymorphisms. XGBoost is rooted in the gradient boosted decision trees, which in contrast to lasso and ridge regression methods, incorporates complex non-linear feature interactions into prediction models in a non-additive form. Exemplary optimization and implementation procedures are provided in Behravan et al. Sci Rep. 2018; 8:13149. A total of ten iterations of 5-fold cross validation were used to obtain an initial list of candidate polymorphisms. These polymorphisms were further filtered/optimized using an adaptive iterative search procedure as outlined in Behravan et al. as well as support vector machines (SVM) resulting in a final list of SNPs, which had high prediction precision (>90%) for the TNFSF15 PRS binary classifier.

Example 4: XGBoost Machine Learning Algorithm Trained on Binary Classifiers Based on TNFSF15 Protein Expression Patients with Crohn's disease (CD) were recruited. The diagnosis of each patient was based on standard endoscopic, histologic, and radiographic features. Blood samples were collected from the patients. All patients were genotyped either by Illumina™ ImmunoArray or polymerase chain reaction (PCR) under standard hybridization conditions. Peripheral blood mononuclear cells (PBMCs) were isolated from the blood samples. The PMBCs were stimulated in vitro with immune complex. Supernatants were collected from unstimulated samples and from stimulated samples at 6, 18, 24, and 72 hours. Soluble TL1A protein in the supernatants was quantified using a plate-based ELISA using and monoclonal antibodies at all time points.

Binary classifiers to be used in the XGBoost machine learning platform for the samples were derived using TL1A protein expression levels at 6 hours. The classifier at 6 hours reflects absolute levels of TL1A protein expression at that time point. Additional binary classifiers were derived using the results of clustering of samples (k=2 and k=3 groups) based on TNFSF15 protein expression across 6, 18, 24, and 72-hour time points. The classifiers at the combination of time points (e.g., 6, 18, 24, and 72) reflect a rate of production of TL1A between time points. The clustering was performed using the TMixClust Bioconductor package as described in Golumbeanu et al. ("Clustering time series gene expression data with TMixClust 2018). A set of predictive SNPs was obtained from each of the three XGBoost analyses of the three classifiers. The polymorphisms identified here were compared to the list of polymorphisms generated in Example 3 to identify only those polymorphisms that overlap between the two analyses.

Determination of overlaps of SNPs was performed on the gene annotation (refGene annotation) of the generated SNPs and not on the actual ICHIP or dbSNP reference sequence identification numbers. Only polymorphisms with minor allele frequencies (MAF)≥0.1 and the beta coefficients (from support vector machine (SVM) runs) with absolute values≥0.1 were kept. This resulted in 129 polymorphisms remaining for further analysis. The 9 polymorphisms used in the TNFF15 PRS (Table 4) were also added to this list of SNPs, resulting in a total of 138 SNPs.

Example 5: Implementation of Market Basket Analysis to Determine Non-Linear Polymorphism Combination Rules Associated with CD In order to further filter out SNPs not strongly associated with clinical phenotypes, a market basket analysis approach was used to determine combination rules for the polymorphisms associated with Crohn's Disease (CD) clinical phenotypes. An exemplary market basket analysis is described in Breuer et al. Int J Bipolar Disord. 2018; 6:24). The initial dataset on CD localization and CD characterization was obtained from 1,803 CD cohorts from Cedars-Sinai Medical Center. The RUDI (Rule Discoverer) program (dominant minor model), also described in Breuer et al., was run on the 1,803 CD cohorts using the genotypes of the previously generated 138 SNPs (Example 4). The analysis resulted in 57 rules with significant associations with clinical phenotypes for Crohn's Disease. The clinical phenotypes used in the analysis were CD location (ileum, colon, and ilealcolon), CD characterization (non-stricturing/non-penetrating, stricturing, stricturing and internal penetrating, and isolated internal penetrating), and presence of perianal disease. The 57 association rules consisted of only 89 out of the 138 input polymorphisms from Example 4. Therefore, only these 89 polymorphisms were considered for further evaluation.

Finally, support vector machines (SVM) analysis based on the 3 binary classifiers described in Example 3 and Example 4 were re-applied to this list of 89 polymorphisms. Only XGBoost models (and their corresponding polymorphisms) with a prediction precision ≥0.70 were maintained. And further, only the polymorphisms from these models with an SVM coefficient ≥0.25 or an SVM coefficient ≤−0.25 were kept. Applying these filters, a total of 41 polymorphisms were generated when analyzing all 3 classifiers. These polymorphisms and reference alleles are provided in Table 1. The nucleic acid sequences comprising the polymorphisms are provided in SEQ ID NOS: 1-41, or 57-59, and the position of the polymorphism within the nucleic acid sequence is indicated with a non-nucleobase letter (e.g., V, R, S, and the like). The sequences provided are from build 151.

The polymorphisms identified in the analysis provided in the Examples above may be used to predict a positive therapeutic response in a subject or a patient to an inhibitor of TL1A activity or expression (e.g., anti-TL1A antibody), either alone, or in combinations (e.g., 2, 3, 4, 5, 6, 7, and so forth). The polymorphisms described herein may be used in a diagnostic or prognostic test to identify a subject suitable for treatment with an inhibitor of TL1A activity or expression to treat a disease or condition described herein in the subject. In some cases, the diagnostic is a companion diagnostic test, such as for example, a TL1A companion diagnostic test ("TL1A CDx").

In a non-limiting example, any combination of three polymorphisms, each selected from Table 1, may be used to predict a positive therapeutic response to an inhibitor of TL1A activity or expression. Exemplary three-polymorphism combinations include: imm_9_116608587, imm_11_127948309, and rs1892231; imm_9_116608587, imm_11_127948309, and rs9806914; imm_9_116608587, imm_11_127948309, and imm_21_44478192; imm_9_116608587, imm_11_127948309, and imm_21_44479552 imm_9_116608587, rs1892231, and rs9806914; imm_9_116608587, rs1892231, and imm_21_44478192; imm_9_116608587, rs1892231, and imm_21_44479552; imm_9_116608587, rs9806914, and imm_21_44478192; imm_9_116608587, rs9806914, and imm_21_44479552; imm_9_116608587, imm_21_44478192, and imm_21_44479552; imm_11_127948309, rs1892231, and rs9806914; imm_11_127948309, rs1892231, and imm_21_44478192; imm_11_127948309, rs1892231, and imm_21_44479552; imm_11_127948309, rs9806914, and imm_21_44478192; imm_11_127948309, rs9806914, and imm_21_44479552; imm_11_127948309, imm_21_44478192, and imm_21_44479552; rs1892231, rs9806914, and imm_21_44478192; rs1892231, rs9806914, and imm_21_44479552; rs1892231, imm_21_44478192, and imm_21_44479552; and rs9806914, imm_21_44478192, and imm_21_44479552.

Table 5 provides a table with the position of each polymorphism provided in Table 1 within the human genome according to GRCh38.p13 Primary Assembly. The nucleic acid sequence flanking each polymorphism is identified with the relevant SEQ ID NO.

TABLE 5

GRCh38.p13 Primary Assembly Positions of Polymorphisms

| dbSNP | SEQ ID NO: | SNP_SEQ_GRCh38.p13 Primary Assembly |
|---|---|---|
| rs11897732 | 60 | >NC_000002.12: 43313747-43314246<br>*Homo sapiens* chromosome 2<br>SEQ = [G/A]<br>>NC_000002.12: 43314248-43314747<br>*Homo sapiens* chromosome 2 |
| rs6740739 | 61 | >NC_000002.12: 43628004-43628503<br>*Homo sapiens* chromosome 2<br>SEQ = [G/A]<br>>NC_000002.12: 43628505-43629004<br>*Homo sapiens* chromosome 2 |
| rs17796285 | 62 | >NC_000008.11: 11266446-11266945<br>*Homo sapiens* chromosome 8<br>SEQ = [G/A/<br>>NC_000008.11: 11266947-11267446<br>*Homo sapiens* chromosome 8 |
| rs7935393 | 63 | >NC_000011.10: 128572704-128573203<br>*Homo sapiens* chromosome 11<br>SEQ = [A/C]<br>>NC_000011.10: 128573205-128573704<br>*Homo sapiens* chromosome 11 |
| rs12934476 | 64 | >NC_000016.10: 11237152-11237651<br>*Homo sapiens* chromosome 16<br>SEQ = [A/G]<br>>NC_000016.10: 1123 7653-11238152<br>*Homo sapiens* chromosome 16 |
| rs12457255 | 65 | >NC_000018.10: 12759477-12759976<br>*Homo sapiens* chromosome 18<br>SEQ = [C/A]<br>>NC_000018.10: 12759978-12760477<br>*Homo sapiens* chromosome 18 |
| rs2070557 | 66 | >NC_000021.9: 44234741-44235240<br>*Homo sapiens* chromosome 21<br>SEQ = [A/T]<br>>NC_000021.9: 44235242-44235741<br>*Homo sapiens* chromosome 21 |

TABLE 5-continued

GRCh38.p13 Primary Assembly Positions of Polymorphisms

| dbSNP | SEQ ID NO: | SNP_SEQ_GRCh38.p13 Primary Assembly |
|---|---|---|
| rs4246905 | 67 | >NC_000009.12: 114790469-114790968<br>*Homo sapiens* chromosome 9<br>SEQ = [T/A/<br>>NC_000009.12: 114790970-114791469<br>*Homo sapiens* chromosome 9 |
| rs10974900 | 68 | >NC_000009.12: 4987458-4987957<br>*Homo sapiens* chromosome 9<br>SEQ = [C/T]<br>>NC_000009.12: 4987959-4988458<br>*Homo sapiens* chromosome 9 |
| rs12434976 | 69 | >NC_000014.9: 98185370-98185869<br>*Homo sapiens* chromosome 14<br>SEQ = [A/C]<br>>NC_000014.9: 98185871-98186370<br>*Homo sapiens* chromosome 14 |
| rs16901748 | 70 | >NC_000005.10: 11561609-11562108<br>*Homo sapiens* chromosome 5<br>SEQ = [G/T]<br>>NC_000005.10: 11562110-11562609<br>*Homo sapiens* chromosome 5 |
| rs2815844 | 71 | >NC_000001.11: 241083704-241084203<br>*Homo sapiens* chromosome 1<br>SEQ = [C/T]<br>>NC_000001.11: 241084205-241084704<br>*Homo sapiens* chromosome 1 |
| rs889702 | 72 | >NC_000016.10: 6088639-6089138<br>*Homo sapiens* chromosome 16<br>SEQ = [G/A]<br>>NC_000016.10: 6089140-6089639<br>*Homo sapiens* chromosome 16 |
| rs2409750 | 73 | >NC_000008.11: 11229685-11230184<br>*Homo sapiens* chromosome 8<br>SEQ = [A/C]<br>>NC_000008.11: 11230186-11230685<br>*Homo sapiens* chromosome 8 |
| rs1541020 | 74 | >NC_000010.11: 6122567-6123066<br>*Homo sapiens* chromosome 10<br>SEQ = [C/T]<br>>NC_000010.11: 6123068-6123567<br>*Homo sapiens* chromosome 10 |
| rs4942248 | 75 | >NC_000013.11: 43832169-43832668<br>*Homo sapiens* chromosome 13<br>SEQ = [T/A]<br>>NC_000013.11: 43832670-43833169<br>*Homo sapiens* chromosome 13 |
| rs12934476 | 76 | >NC_000016.10: 11237152-11237651<br>*Homo sapiens* chromosome 16<br>SEQ = [A/G]<br>>NC_000016.10: 1123 7653-11238152<br>*Homo sapiens* chromosome 16 |
| rs12457255 | 77 | >NC_000018.10: 12759477-12759976<br>*Homo sapiens* chromosome 18<br>SEQ = [C/A]<br>>NC_000018.10: 12759978-12760477<br>*Homo sapiens* chromosome 18 |
| rs2297437 | 78 | >NC_000020.11: 63673421-63673920<br>*Homo sapiens* chromosome 20<br>SEQ = [G/A]<br>>NC_000020.11: 63673922-63674421<br>*Homo sapiens* chromosome 20 |
| rs41309367 | 79 | >NC_000020.11: 63677701-63678200<br>*Homo sapiens* chromosome 20<br>SEQ = [C/T]<br>>NC_000020.11: 63678202-63678701<br>*Homo sapiens* chromosome 20 |
| rs10733509 | 80 | >NC_000009.12: 4307550-4308049<br>*Homo sapiens* chromosome 9<br>SEQ = [A/G]<br>>NC_000009.12: 4308051-4308550<br>*Homo sapiens* chromosome 9 |
| rs10750376 | 81 | >NC_000011.10: 127867534-127868033<br>*Homo sapiens* chromosome 11<br>SEQ = [C/T]<br>>NC_000011.10: 127868035-127868534<br>*Homo sapiens* chromosome 11 |

TABLE 5-continued

GRCh38.p13 Primary Assembly Positions of Polymorphisms

| dbSNP | SEQ ID NO: | SNP_SEQ_GRCh38.p13 Primary Assembly |
|---|---|---|
| rs10932456 | 82 | >NC_000002.12: 212988031-212988530<br>*Homo sapiens* chromosome 2<br>SEQ = [A/G]<br>>NC_000002.12: 212988532-212989031<br>*Homo sapiens* chromosome 2 |
| rs1326860 | 83 | >NC_000001.11: 193834579-193835078<br>*Homo sapiens* chromosome 1<br>SEQ = [A/G]<br>>NC_000001.11: 193835080-193835579<br>*Homo sapiens* chromosome 1 |
| rs1528663 | 84 | >NC_000011.10: 13945175-13945674<br>*Homo sapiens* chromosome 11<br>SEQ = [G/A]<br>>NC_000011.10: 13945676-13946175<br>*Homo sapiens* chromosome 11 |
| rs1892231 | 85 | >NC_000014.9: 98267730-98268229<br>*Homo sapiens* chromosome 14<br>SEQ = [A/C]<br>>NC_000014.9: 98268231-98268730<br>*Homo sapiens* chromosome 14 |
| rs951279 | 86 | >NC_000001.11: 208593050-208593549<br>*Homo sapiens* chromosome 1<br>SEQ = [A/G]<br>>NC_000001.11: 208593551-208594050<br>*Homo sapiens* chromosome 1 |
| rs9806914 | 87 | >NC_000016.10: 6097144-6097643<br>*Homo sapiens* chromosome 16<br>SEQ = [A/C]<br>>NC_000016.10: 6097645-6098144<br>*Homo sapiens* chromosome 16 |
| rs7935393 | 88 | >NC_000011.10: 128572704-128573203<br>*Homo sapiens* chromosome 11<br>SEQ = [A/C]<br>>NC_000011.10: 128573205-128573704<br>*Homo sapiens* chromosome 11 |
| rs1690492 | 89 | >NC_000016.10: 11224459-11224958<br>*Homo sapiens* chromosome 16<br>SEQ = [G/C]<br>>NC_000016.10: 11224960-11225459<br>*Homo sapiens* chromosome 16 |
| rs420726 | 90 | >NC_000021.9: 44239062-44239561<br>*Homo sapiens* chromosome 21<br>SEQ = [T/C]<br>>NC_000021.9: 44239563-44240062<br>*Homo sapiens* chromosome 21 |
| rs7759385 | 91 | >NC_000006.12: 106140395-106140894<br>*Homo sapiens* chromosome 6<br>SEQ = [T/A]<br>>NC_000006.12: 106140896-106141395<br>*Homo sapiens* chromosome 6 |
| rs10974900 | 92 | >NC_000009.12: 4987458-4987957<br>*Homo sapiens* chromosome 9<br>SEQ = [C/T]<br>>NC_000009.12: 4987959-4988458<br>*Homo sapiens* chromosome 9 |
| rs1326860 | 93 | >NC_000001.11: 193834579-193835078<br>*Homo sapiens* chromosome 1<br>SEQ = [A/G]<br>>NC_000001.11: 193835080-193835579<br>*Homo sapiens* chromosome 1 |
| rs2548147 | 94 | >NC_000005.10: 40151459-40151958<br>*Homo sapiens* chromosome 5<br>SEQ = [G/C]<br>>NC_000005.10: 40151960-40152459<br>*Homo sapiens* chromosome 5 |
| rs2815844 | 95 | >NC_000001.11: 241083704-241084203<br>*Homo sapiens* chromosome 1<br>SEQ = [C/T]<br>>NC_000001.11: 241084205-241084704<br>*Homo sapiens* chromosome 1 |
| rs889702 | 96 | >NC_000016.10: 6088639-6089138<br>*Homo sapiens* chromosome 16<br>SEQ = [G/A]<br>>NC_000016.10: 6089140-6089639<br>*Homo sapiens* chromosome 16 |
| rs9806914 | 97 | >NC_000016.10: 6097144-6097643<br>*Homo sapiens* chromosome 16<br>SEQ = [A/C/<br>>NC_000016.10: 6097645-6098144<br>*Homo sapiens* chromosome 16 |
| rs6478109 | 98 | >NC_000009.12: 114805986-114806485<br>*Homo sapiens* chromosome 9<br>SEQ = [A/G<br>>NC_000009.12: 114806487-114806986<br>*Homo sapiens* chromosome 9 |
| rs7278257 | 99 | >NC_000021.9: 44233381-44233880<br>*Homo sapiens* chromosome 21<br>SEQ = [G/C]<br>>NC_000021.9: 44233882-44234381<br>*Homo sapiens* chromosome 21 |
| rs11221332 | 100 | >NC_000011.10: 128510579-128511078<br>*Homo sapiens* chromosome 11<br>SEQ = [C/A/<br>>NC_000011.10: 128511080-128511579<br>*Homo sapiens* chromosome 11 |
| rs56124762 | 101 | >NC_000021.9: 44238091-44238590<br>*Homo sapiens* chromosome 21<br>SEQ = [A/G]<br>>NC_000021.9: 44238592-44239091<br>*Homo sapiens* chromosome 21 |
| rs2070558 | 102 | >NC_000021.9: 44235275-44235774<br>*Homo sapiens* chromosome 21<br>SEQ = [G/A]<br>>NC_000021.9: 44235776-44236275<br>*Homo sapiens* chromosome 21 |
| rs2070561 | 103 | >NC_000021.9: 44237587-44238086<br>*Homo sapiens* chromosome 21<br>SEQ = [T/C]<br>>NC_000021.9: 44238088-44238587<br>*Homo sapiens* chromosome 21 |
| rs7134599 | 104 | >NC_000012.12: 68105795-68106294<br>*Homo sapiens* chromosome 12<br>SEQ = [G/A]<br>>NC_000012.12: 68106296-68106795<br>*Homo sapiens* chromosome 12 |
| rs6062496 | 105 | >NC_000020.11: 63697246-63697745<br>*Homo sapiens* chromosome 20<br>SEQ = [G/A]<br>>NC_000020.11: 63697747-63698246<br>*Homo sapiens* chromosome 20 |
| rs7468800 | 106 | >NC_000009.12: 114829225-114829724<br>*Homo sapiens* chromosome 9<br>SEQ = [C/A]<br>>NC_000009.12: 114829726-114830225<br>*Homo sapiens* chromosome 9 |
| rs1569328 | 107 | >NC_000014.9: 75274548-75275047<br>*Homo sapiens* chromosome 14<br>SEQ = [C/T]<br>>NC_000014.9: 75275049-75275548<br>*Homo sapiens* chromosome 14 |
| rs2284553 | 108 | >NC_000021.9: 33403889-33404388<br>*Homo sapiens* chromosome 21<br>SEQ = [A/G]<br>>NC_000021.9: 33404390-33404889<br>*Homo sapiens* chromosome 21 |
| rs6062504 | 364141 | >NC_000020.11: 63717055-63717554<br>*Homo sapiens* chromosome 20<br>SEQ = [A/G/<br>>NC_000020.11: 63717556-63718055<br>*Homo sapiens* chromosome 20 |
| rs7556897 | 364142 | >NC_000002.12: 227794896-227795395<br>*Homo sapiens* chromosome 2<br>SEQ = [C/G/<br>>NC_000002.12: 227795397-227795896<br>*Homo sapiens* chromosome 2 |

Example 6. Validation of 3-SNP Models for TL1A Companion Diagnostic

The machine learning workflow identified several SNP model combinations for the development of the TL1A companion diagnostic (TL1A CDx). Previous analyses had identified 3-SNP combination models composed of variants associated with TNFSF15 (rs6478109), ICOSLG (rs7278257, rs2070557), ETS1 (rs7935393), and RBFOX1 (rs9806914) genes as well as variant rs1892231. These SNP models were identified via a Cedars Sinai Crohn's Disease cohort. In order to validate the findings, an external cohort of Crohn's Disease patients was identified and genotyped. Genotype and TL1A protein expression were obtained from the non-Cedars cohort in order to validate the 3-SNP models. A total of 712 Crohn's Disease individuals were genotyped while a 114 subset of the 712 samples were used to obtain TL1A protein expression via PBMC assays.

Genotyping and Imputation of Cohort

The initial data mining analyses was performed on a Cedars Sinai cohort using genotypes from the Illumina'S™ ICHIP (Immunochip) platform. The validation cohort was genotyped using Illumina's™ GSA platform (24v2.0), which has substantial improvements over the Immunochip platform. Most of the SNPs identified in the models were not present on the GSA platform. Therefore, imputation of the GSA genotype data was initiated in order to obtain a larger panel of genotyped SNPs so the SNP models could be validated. Genotype imputation refers to the prediction of genotypes that are not directly assayed on a given platform. Different methodologies and significant improvements in algorithms have been developed for implementing genotype imputation. The quality of the genotype imputation was validated by selecting a random sample of 120 patients from our validation cohort to be genotyped for a small set of imputed SNPs. The overall agreement between imputed genotype and assay genotypes were evaluated using Cohen's Kappa statistic.

Validation cohort genotyped results were downloaded from Illumina™ and transformed into PED format (through Illumina'S™ Genome Studio Workbench) so that they could be further processed using the PLINK software (v1.9). The genotyped data went through a process of QC looking at factors such as heterozygosity, SNP missingness, MAF distributions, and relatedness of samples in order to prepare the genotype data for ancestry determination. Once genotyped data was QCed, the admixture and ancestry PCA plots were used to determine which samples were of European (EUR) ancestry to move forward with imputation. In order to perform imputation, ancestry needs to be taken into account, since genotype reference panels based on ancestry are used by imputation algorithms. For our imputation, the European Reference Panel: hrc.r1.1 for the reference panel was selected. All qc'd EUR ancestry genotyped samples were submitted to the Michigan Imputation Server for genotype imputation. The resulting imputed genotypes were downloaded and further processed for model validation.

In order to move forward with analyzing the imputed genotypes for the 3-SNP model validation, a random selection of 120 samples from the initial 470 samples were sent to Illumina™ for genotyping in order to compare the imputed genotype with the actual laboratory genotype results. The imputed genotypes were evaluated by looking at the level of agreement for the following SNPs: rs6478109, rs2070557, rs1892231, rs7935393.

The SNP rs6478109 was already on the GSA platform and this was used as a "control" to determine that the assay was in fact working appropriately. The levels of agreement (based on Cohen's Kappa) were high (based on the table below) and therefore it was decided to move forward with using the imputed genotype data for further analysis.

TABLE 7

Levels of Agreement Based On Cohen's Kappa

| SNP | Rsq | Cohen's Kappa |
|---|---|---|
| rs6478109 | 0.998 | 1.00 |
| rs2070557 | 0.978 | 0.98 |
| rs1892231 | 0.989 | 1.00 |
| rs7935393 | 0.980 | 1.00 |

Evaluation and Validation of 3-SNP Models

Figure 5A:
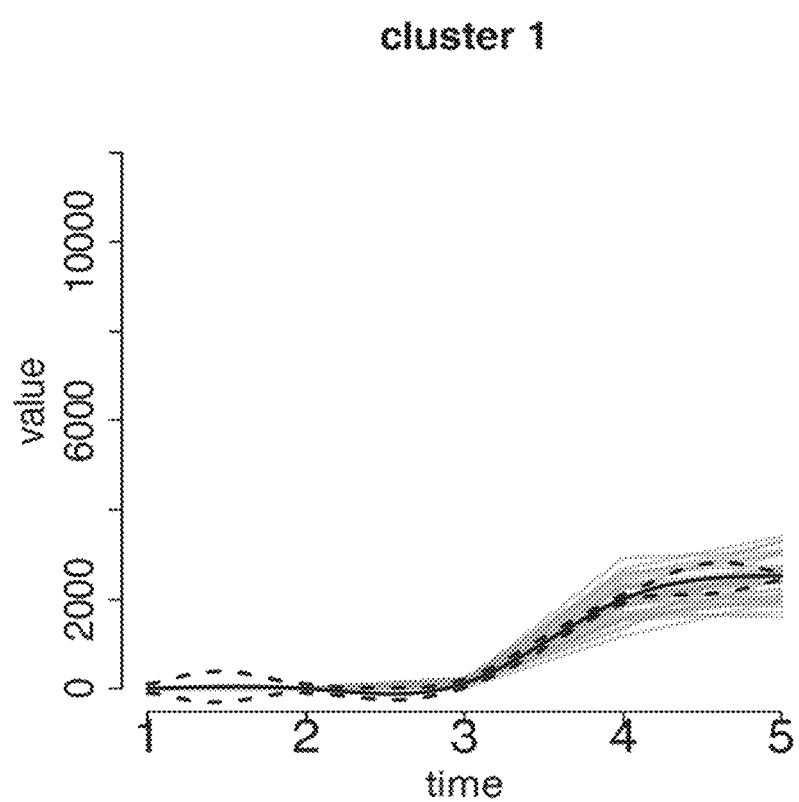
FIG. 5A-5C shows a clustering analysis within our the TL1A companion diagnostic (CDx) dataset.
Figure 5B:
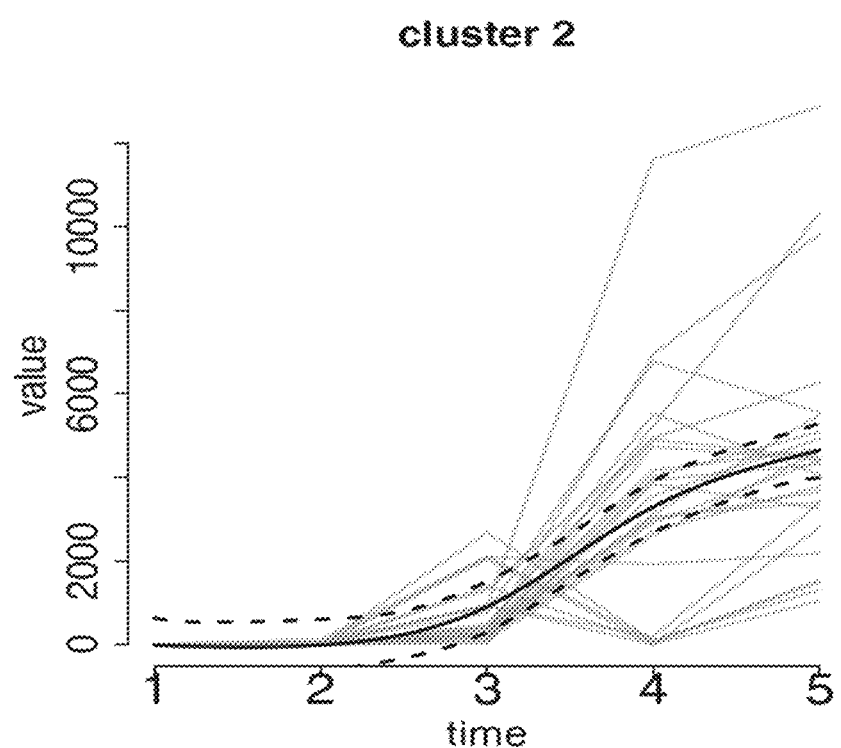
Figure 5C:
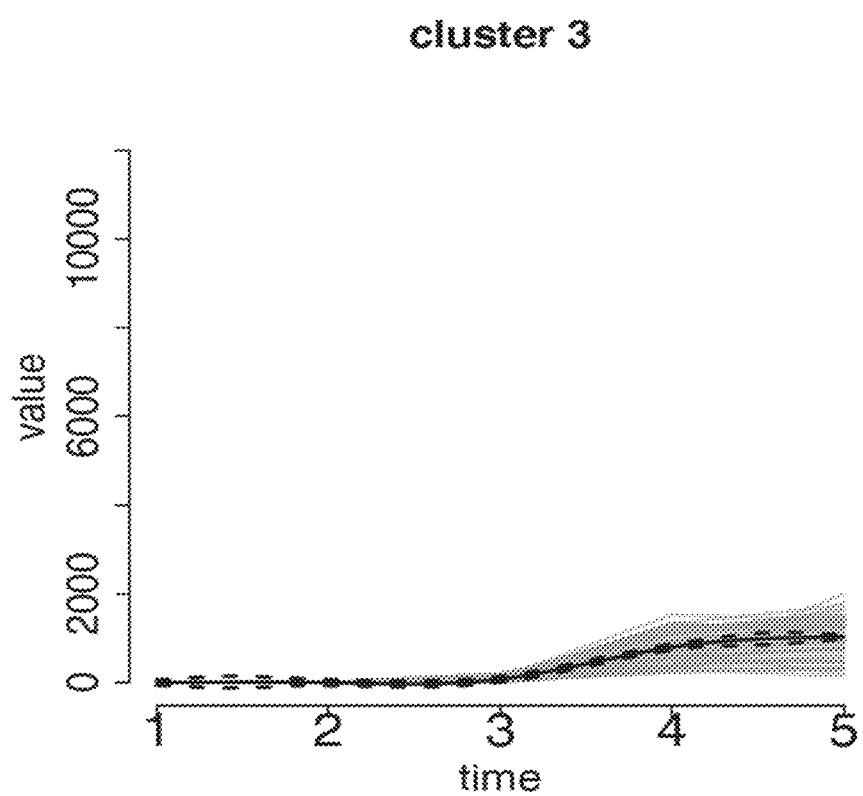

Next, the initial 3-SNP models were evaluated using the validation cohort. Similar to the analysis of the Cedars cohort TL1A protein expression data, the TL1A Expression (based on PBMC assay) from the validation cohort was clustered using the TL1A measurements at the 0, 3, 6, 24, and 72 hour time points. The clustering identified 3 cluster within the dataset, which are provided in FIG. 5A-5C. FIG. 5A shows cluster 1, FIG. 5B shows cluster 2, and FIG. 5C shows cluster 3.

Figure 6:
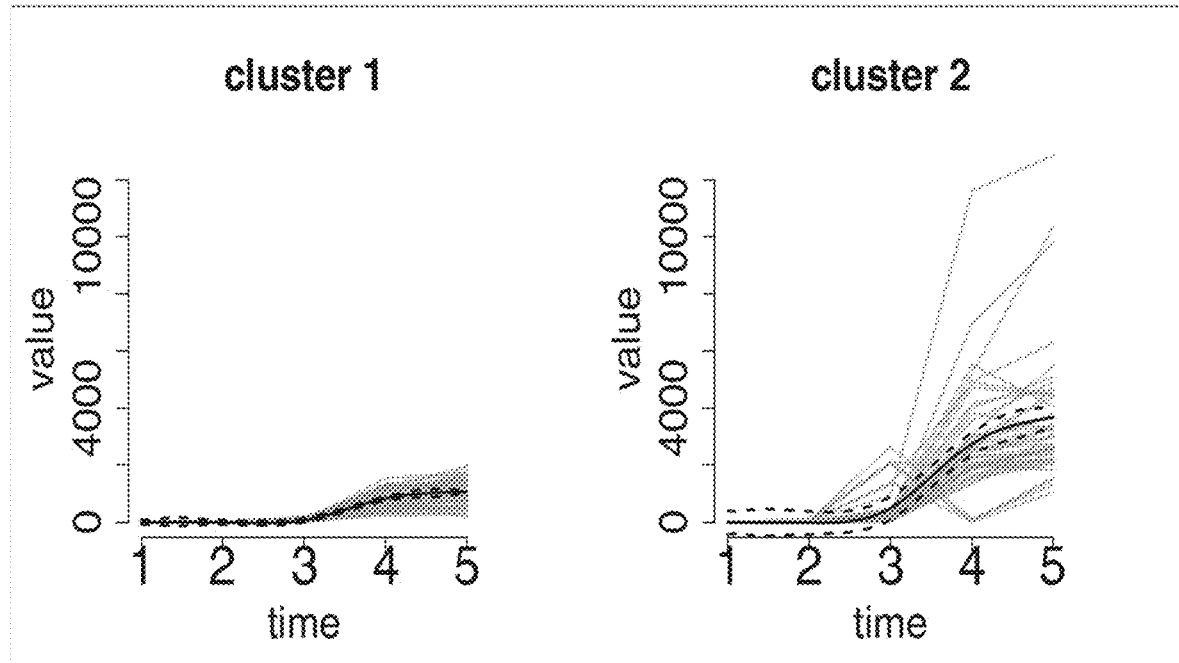
FIG. 6 shows that the 3 clusters from FIG. 5A-5C were collapsed into 2 clusters (high TL1A expression clusters shown on the left) and (low TL1A expression clusters on the right).

The 3 clusters were collapsed into 2 clusters (high expression clusters) and (low expression clusters), which are shown in FIG. 6. The clusters above were collapsed down to two clusters because there was substantial overlap between cluster 3 (FIG. 5C) above and cluster 1 (FIG. 6, left). The same level of overlap was seen for clusters 1 (FIG. 5A) and 2 (FIG. 5B) (based on the 3 clusters) and cluster 2 (FIG. 6, right).

The imputed genotype data were integrated from the validation cohort with the TL1A protein expression data in order to determine which models validated in the external validation cohort. This was done by looking at results of the TL1A CDx 3-SNP model. The 3-SNP models were evaluated in the context of the validation cohort and the TL1A expression clusters. "Positive" genotype hits were determined based on the association of a particular genotype and its ability to associate with the higher expressing TL1A cluster. Without being bound by any particular theory, high TL1A clusters (e.g., high expression of TL1A in CD patients, relative to baseline expression of TL1A in normal individuals) directly correlates with positive therapeutic responsiveness to an inhibitor of TL1A activity or expression; whereas low TL1A clusters (e.g., low TL1A expression in CD patients, relative to baseline expression of TL1A in normal individuals) directly correlates to non-responsiveness to an inhibitor of TL1A activity or expression.

Calculations of Positive Predictive Value (PPV) and Specificity were calculated for the 3-SNP models. Each model consists of 3 unique SNPs based off of the identified SNPs in our training cohort analysis (TNFSF15 (rs6478109), ICOSLG(rs7278257, rs2070557), ETS1 (rs7935393), and RBFOX1 (rs9806914) genes as well as variant rs1892231). The PPV and Specificity for Models A-C are provided in Table 8. As shown in Table 8, Model A may be used to predict a positive therapeutic response to a treatment with an inhibitor of TL1A activity or expression with a PPV of at least or about 0.797 and a specificity of at least or about 0.816 (when considering both training and validation cohorts combined). Model A was further explored due to its better performance compared to Models B and C (when considering both training and validation cohorts combined).

TABLE 8

Exemplary 3-SNP Models A-C

| Model | Training Cohort | | Validation Cohort | | Combined | | |
|---|---|---|---|---|---|---|---|
| | PPV | SPEC | PPV | SPEC | PPV | SPEC | CD FREQ |
| A | 0.902 | 0.867 | 0.643 | 0.783 | 0.797 | 0.816 | 38.7 |
| B | 0.806 | 0.767 | 0.682 | 0.848 | 0.759 | 0.816 | 26.3 |
| C | 0.838 | 0.800 | 0.576 | 0.696 | 0.714 | 0.737 | 36.7 |

Other previously identified 3-SNP models were further evaluated due the fact that only Model A showed strong concordance of positive hit genotypes across the training and validation cohorts. These additional SNP models (Models D-K) consisted of 3-SNP combinations of the following SNPs: rs6478109, rs7935393, rs9806914, rs16901748, rs2070557, rs7278257, rs2297437, rs1892231, as shown in Table 9.

TABLE 9

3-SNP Models D-K

| Model | Cohort 1 | | Cohort 2 | | Combined | | |
|---|---|---|---|---|---|---|---|
| | PPV | SPEC | PPV | SPEC | PPV | SPEC | CD FREQ |
| D | 0.815 | 0.833 | 0.750 | 0.848 | 0.782 | 0.842 | 18.6 |
| E | 0.848 | 0.833 | 0.606 | 0.717 | 0.727 | 0.763 | 31.2 |
| F | 0.909 | 0.933 | 0.667 | 0.870 | 0.800 | 0.895 | 18.3 |
| G | 0.917 | 0.933 | 0.609 | 0.804 | 0.766 | 0.855 | 22.6 |
| H | 0.923 | 0.967 | 0.727 | 0.935 | 0.833 | 0.947 | 12.9 |
| I | 0.941 | 0.967 | 0.733 | 0.913 | 0.844 | 0.934 | 17.2 |
| J | 0.923 | 0.967 | 0.727 | 0.935 | 0.833 | 0.947 | 12.9 |
| K | 0.844 | 0.833 | 0.731 | 0.848 | 0.793 | 0.842 | 23.9 |

As before, the PPV and Specificity for each model was evaluated in the context of positive and negative hits and their association with high and lower TL1A clusters. After evaluating the models across both training and validation cohorts, an additional model (Model K) was evaluated, which contained SNP, rs16901748 (CTNND2), which had not been utilized in our previous models (based on the initial training cohort).
ICOSLG Proxy SNP Selection One of ICOSLG SNPs (rs7278257) was determined to be challenging to genotype given the SNP location within the genome. Therefore, candidate proxy SNPs to rs7278257 were identified. The proxy SNPs were identified via LDLink. A list of potential proxy SNPs for rs7278257 is shown below in Table 10.

TABLE 10

Proxy SNPs Utilized in Validation

| RS Number | Coord | Alleles | MAF | Distance | Dprime | R2 |
|---|---|---|---|---|---|---|
| rs7278257 | chr21: 45653764 | (G/C) | 0.2833 | 0 | 1 | 1 |
| rs56124762 | chr21: 45658474 | (A/G) | 0.2763 | 4710 | 0.9849 | 0.9372 |
| rs11558819 | chr21: 45656774 | (C/T) | 0.2873 | 3010 | 0.9705 | 0.9236 |
| rs2070557 | chr21: 45655124 | (A/T) | 0.2972 | 1360 | 0.9651 | 0.8705 |
| rs2070558 | chr21: 45655658 | (G/A) | 0.2952 | 1894 | 0.9602 | 0.87 |
| rs2329718 | chr21: 45656199 | (T/C) | 0.2952 | 2435 | 0.9602 | 0.87 |
| rs2070559 | chr21: 45657700 | (C/G) | 0.2982 | 3936 | 0.96 | 0.8573 |
| rs2070560 | chr21: 45657848 | (C/G) | 0.2972 | 4084 | 0.9551 | 0.8526 |
| rs2070561 | chr21: 45657970 | (T/C) | 0.2972 | 4206 | 0.9551 | 0.8526 |

Next, the SNPs provided in Table 10 were analyzed for relevant inflammatory bowel disease related clinical associations within the Cedars R/Shiny database. From the SNPs above, the following SNPs had relevant clinical associations (examples include key phenotypes: CD vs. Ctrl,IBD vs. Ctrl,L1 B2a+B2b vs B1): rs2070561, rs56124762, rs2070558, rs11558819. CD v. Ctrl refers to cases of Crohn's disease versus cases of controls (individuals without Crohn's disease); IBD vs. Ctrl refers to cases of inflammatory bowel disease versus cases of controls (individuals without IBD); L1 refers to the ileum; B2a+B2b refers to stricturing and penetrating disease; B1 refers to non-stricturing and non-penetrating disease.

Example 7. Validation in Japanese Cohort

An external cohort of Crohn's Disease patients of Japanese ancestry is identified and genotyped. Genotype and TL1A protein expression are obtained from second Japanese cohort in order to validate the 3-SNP models. A total of 800 Crohn's Disease individuals are genotyped while a 100 subset of the 800 samples are used to obtain TL1A protein expression via PBMC assays.

The initial 3-SNP models are evaluated using the Japanese validation cohort. Similar to the analysis of the validation cohort in Example 6, the TL1A Expression (based on PBMC assay) from the validation cohort is clustered using the TL1A measurements at the 0, 3, 6, 24, and 72 hour time points. The clustering identifies at least 2 clusters in the dataset: (i) high expression clusters and (ii) low expression clusters.

The imputed genotype data are integrated from the Japanese validation cohort with the TL1A protein expression data in order to determine which models validated in the Japanese validation cohort. This is done by looking at results of the TL1A CDx 3-SNP model. The 3-SNP models are evaluated in the context of the Japanese validation cohort and the TL1A expression clusters. "Positive" genotype hits are determined based on the association of a particular genotype and its ability to associate with the higher expressing TL1A cluster. Calculations of PPV and Specificity are calculated for the 3-SNP models. Each model consists of 3 unique SNPs based off of the identified SNPs in the training cohort analysis (TNFSFJ5 (rs6478109), ICOSLG (rs7278257, rs2070557), ETS1 (rs7935393), and RBFOXJ (rs9806914) genes as well as variant rs1892231). The 3-SNP models shown in Table 8 and Table 9 are explored in this validation. The PPV and SPEC values expected in the Japanese validation cohort for Models A-K are the same as those reported in Table 8 and 9. Without being bound by any particular theory, validation of the 3-SNP models for the TL1A CDx is expected across all ancestral populations.

Candidate proxy SNPs to any one of the SNPs provided in Table 8 or Table 9 may be identified. The proxy SNPs are identified via LDLink using a reference population of Japanese ancestry. The proxy SNPs are further analyzed for relevant inflammatory bowel disease related clinical associations within the Cedars R/Shiny database in Japanese cohorts, such as for example, CD vs. Ctrl,IBD vs. Ctrl,L1 B2a+B2b vs B1).

Example 8: Phase I Clinical Trial

A phase 1 clinical trial is performed to evaluate the safety, tolerability, pharmacokinetics and pharmacodynamics of an anti-TL1A antibody on subjects having Crohn's disease (CD).

Single ascending dose (SAD) arms: Subjects in each group (subjects are grouped based on the presence of a genotype comprising at least one, and preferably three, polymorphism(s) selected from Table 1 and subjects without the presence of the genotype) receive either a single dose of the antibody or a placebo. Exemplary doses are 1, 3, 10, 30, 100, 300, 600 and 800 mg of antibody. Safety monitoring and PK assessments are performed for a predetermined time. Based on evaluation of the PK data, and if the antibody is deemed to be well tolerated, dose escalation occurs, either within the same groups or a further group of healthy subjects. Dose escalation continues until the maximum dose has been attained unless predefined maximum exposure is reached or intolerable side effects become apparent.

Multiple ascending dose (MAD) arms: Subjects in each group (subjects are grouped based on the same criteria as above) receive multiple doses of the antibody or a placebo. The dose levels and dosing intervals are selected as those that are predicted to be safe from the SAD data. Dose levels and dosing frequency are chosen to achieve therapeutic drug levels within the systemic circulation that are maintained at steady state for several days to allow appropriate safety parameters to be monitored. Samples are collected and analyzed to determination PK profiles.

Inclusion Criteria: Healthy subjects of non-childbearing potential between the ages of 18 and 55 years. Healthy is defined as no clinically relevant abnormalities identified by a detailed medical history, full physical examination, including blood pressure and pulse rate measurement, 12 lead ECG and clinical laboratory tests. Female subjects of non-childbearing potential must meet at least one of the following criteria: (1) achieved postmenopausal status, defined as: cessation of regular menses for at least 12 consecutive months with no alternative pathological or physiological cause; and have a serum follicle stimulating hormone (FSH) level within the laboratory's reference range for postmenopausal females; (2) have undergone a documented hysterectomy and/or bilateral oophorectomy; (3) have medically confirmed ovarian failure. All other female subjects (including females with tubal ligations and females that do NOT have a documented hysterectomy, bilateral oophorectomy and/or ovarian failure) will be considered to be of childbearing potential. Body Mass Index (BMI) of 17.5 to 30.5 kg/m2; and a total body weight >50 kg (110 lbs). Evidence of a personally signed and dated informed consent document indicating that the subject (or a legal representative) has been informed of all pertinent aspects of the study.

Two groups of CD patients are selected: patients having the genotype described herein, and patients without the genotype. For example, the genotype may comprise rs6478109, rs56124762, and rs1892231; rs6478109, rs56124762, and rs16901748; rs6478109, rs1892231, and rs16901748; rs56124762, rs1892231, and rs16901748; rs6478109, rs2070558, and rs1892231; rs6478109, rs2070558, and rs16901748; rs6478109, rs1892231, and rs16901748; rs2070558, rs1892231, and rs16901748; rs6478109, rs2070561, and rs1892231; rs6478109, rs2070561, and rs16901748; rs6478109, rs1892231, and rs16901748; rs2070561, rs1892231, and rs16901748; rs6478109, rs7935393, and rs1892231; rs6478109, rs7935393, and rs9806914; rs6478109, rs7935393, and rs7278257; rs6478109, rs7935393, and rs2070557; rs6478109, rs1892231, and rs9806914; rs6478109, rs1892231, and rs7278257; rs6478109, rs1892231, and rs2070557; rs6478109, rs9806914, and rs7278257; rs6478109, rs9806914, and rs2070557; rs6478109, rs7278257, and rs2070557; rs7935393, rs1892231, and rs9806914; rs7935393, rs1892231, and rs7278257; rs7935393, rs1892231, and rs2070557; rs7935393, rs9806914, and rs7278257; rs7935393, rs9806914, and rs2070557; rs7935393, rs7278257, and rs2070557; rs1892231, rs9806914, and rs7278257; rs1892231, rs9806914, and rs2070557; rs1892231, rs7278257, and rs2070557; or rs9806914, rs7278257, and rs2070557.

Exclusion Criteria: Evidence or history of clinically significant hematological, renal, endocrine, pulmonary, gastrointestinal, cardiovascular, hepatic, psychiatric, neurologic, or allergic disease (including drug allergies, but excluding untreated, asymptomatic, seasonal allergies at time of dosing). Subjects with a history of or current positive results for any of the following serological tests: Hepatitis B surface antigen (HBsAg), Hepatitis B core antibody (HBcAb), anti-Hepatitis C antibody (HCV Ab) or human immunodeficiency virus (HIV). Subjects with a history of allergic or anaphylactic reaction to a therapeutic drug. Treatment with an investigational drug within 30 days (or as determined by the local requirement, whichever is longer) or 5 half-lives or 180 days for biologics preceding the first dose of study medication. Pregnant females; breastfeeding females; and females of childbearing potential.

Primary Outcome Measures: Incidence of dose limiting or intolerability treatment related adverse events (AEs) [Time Frame: 12 weeks]. Incidence, severity and causal relationship of treatment emergent AEs (TEAEs) and withdrawals due to treatment emergent adverse events [Time Frame: 12 weeks]. Incidence and magnitude of abnormal laboratory findings [Time Frame: 12 weeks]. Abnormal and clinically relevant changes in vital signs, blood pressure (BP) and electrocardiogram (ECG) parameters [Time Frame: 12 weeks].

Secondary Outcome Measures: Single Ascending Dose: Maximum Observed Plasma Concentration (C max) [Time Frame: 12 weeks]. Single Ascending Dose: Time to Reach Maximum Observed Plasma Concentration (T max) [Time Frame: 12 weeks]. Single Ascending Dose: Area under the plasma concentration-time profile from time zero to 14 days (AUC14 days) [Time Frame: 12 weeks]. Single Ascending Dose: Area under the plasma concentration-time profile from time zero extrapolated to infinite time (AUCinf) [Time Frame: 12 weeks]. Single Ascending Dose: Area under the plasma concentration-time profile from time zero to the time of last quantifiable concentration (AUClast) [Time Frame: 12 weeks]. Single Ascending Dose: Dose normalized maximum plasma concentration (C max[dn]) [Time Frame: 12 weeks]. Single Ascending Dose: Dose normalized area under the plasma concentration-time profile from time zero extrapolated to infinite time (AUCinf[dn]) [Time Frame: 12 weeks]. Single Ascending Dose: Dose normalized area under the plasma concentration-time profile from time zero to the time of last quantifiable concentration (AUClast[dn]) [Time Frame: 12 weeks]. Single Ascending Dose: Plasma Decay Half-Life (t½) [Time Frame: 12 weeks]. Plasma decay half-life is the time measured for the plasma concentration to decrease by one half. Single Ascending Dose: Mean residence time (MRT) [Time Frame: 12 weeks]. Single Ascending Dose: Volume of Distribution at Steady State (Vss) [Time Frame: 6 weeks]. Volume of distribution is defined as the theoretical volume in which the total amount of drug would need to be uniformly distributed to produce the desired blood concentration of a drug. Steady state volume of distribution (Vss) is the apparent volume of distribution at steady-state. Single Ascending Dose: Systemic Clearance (CL) [Time Frame: 6]. CL is a quantitative measure of the rate at which a drug substance is removed from the body.

Multiple Ascending Dose First Dose: Maximum Observed Plasma Concentration (C max) [Time Frame: 12 weeks]. Multiple Ascending Dose First Dose: Time to Reach Maximum Observed Plasma Concentration (T max) [Time Frame: 12 weeks]. Multiple Ascending Dose First Dose: Area under the plasma concentration-time profile from time zero to time T, the dosing interval where τ=2 weeks (AUCτ) [Time Frame: 12 weeks]. Multiple Ascending Dose First Dose: Dose normalized maximum plasma concentration (C max[dn]) [Time Frame: 12 weeks]. Multiple Ascending Dose First Dose: Dose normalized Area under the plasma concentration-time profile from time zero to time τ, the dosing interval where τ=2 weeks (AUCτ[dn]) [Time Frame: 12 weeks]. Plasma Decay Half-Life (t½) [Time Frame: 12 weeks]. Plasma decay half-life is the time measured for the plasma concentration to decrease by one half. Multiple Ascending Dose First Dose: Mean residence time (MRT) [Time Frame: 12 weeks]. Apparent Volume of Distribution (Vz/F) [Time Frame: 12 weeks]. Volume of distribution is defined as the theoretical volume in which the total amount of drug would need to be uniformly distributed to produce the desired plasma concentration of a drug. Apparent volume of distribution after oral dose (Vz/F) is influenced by the fraction absorbed. Multiple Ascending Dose First Dose: Volume of Distribution at Steady State (Vss) [Time Frame: 12 weeks]. Volume of distribution is defined as the theoretical volume in which the total amount of drug would need to be uniformly distributed to produce the desired blood concentration of a drug. Steady state volume of distribution (Vss) is the apparent volume of distribution at steady-state. Multiple Ascending Dose First Dose: Apparent Oral Clearance (CL/F) [Time Frame: 12 weeks]. Clearance of a drug is a measure of the rate at which a drug is metabolized or eliminated by normal biological processes. Clearance obtained after oral dose (apparent oral clearance) is influenced by the fraction of the dose absorbed. Clearance is estimated from population pharmacokinetic (PK) modeling. Drug clearance is a quantitative measure of the rate at which a drug substance is removed from the blood. Multiple Ascending Dose First Dose: Systemic Clearance (CL) [Time Frame: 12 weeks]. CL is a quantitative measure of the rate at which a drug substance is removed from the body.

Multiple Ascending Dose Multiple Dose: Maximum Observed Plasma Concentration (C max) [Time Frame: 12 weeks]. Multiple Ascending Dose Multiple Dose: Time to Reach Maximum Observed Plasma Concentration (T max) [Time Frame: 12 weeks]. Multiple Ascending Dose Multiple Dose: Area under the plasma concentration-time profile from time zero to time τ, the dosing interval where τ=2 weeks (AUCτ) [Time Frame: 12 weeks]. Multiple Ascending Dose Multiple Dose: Dose normalized maximum plasma concentration (C max[dn]) [Time Frame: 12 weeks]. Multiple Ascending Dose Multiple Dose: Dose normalized Area under the plasma concentration-time profile from time zero to time τ, the dosing interval where τ=2 weeks (AUCτ[dn]) [Time Frame: 12 weeks]. Multiple Ascending Dose Multiple Dose: Plasma Decay Half-Life (t½) [Time Frame: 12 weeks]. Plasma decay half-life is the time measured for the plasma concentration to decrease by one half. Multiple Ascending Dose Multiple Dose: Apparent Volume of Distribution (Vz/F) [Time Frame: 12 weeks]. Volume of distribution is defined as the theoretical volume in which the total amount of drug would need to be uniformly distributed to produce the desired plasma concentration of a drug. Apparent volume of distribution after oral dose (Vz/F) is influenced by the fraction absorbed. Multiple Ascending Dose Multiple Dose: Volume of Distribution at Steady State (Vss) [Time Frame: 12 weeks]. Volume of distribution is defined as the theoretical volume in which the total amount of drug would need to be uniformly distributed to produce the desired blood concentration of a drug. Steady state volume of distribution (Vss) is the apparent volume of distribution at steady-state.

Multiple Ascending Dose Multiple Dose: Apparent Oral Clearance (CL/F) [Time Frame: 12 weeks]. Clearance of a drug is a measure of the rate at which a drug is metabolized or eliminated by normal biological processes. Clearance obtained after oral dose (apparent oral clearance) is influenced by the fraction of the dose absorbed. Clearance was estimated from population pharmacokinetic (PK) modeling. Drug clearance is a quantitative measure of the rate at which a drug substance is removed from the blood. Multiple Ascending Dose Multiple Dose: Systemic Clearance (CL) [Time Frame: 12 weeks]. CL is a quantitative measure of the rate at which a drug substance is removed from the body. Multiple Ascending Dose Multiple Dose: Minimum Observed Plasma Trough Concentration (Cmin) [Time Frame: 12 weeks]. Multiple Ascending Dose Multiple Dose: Average concentration at steady state (Cav) [Time Frame: 12 weeks]. Multiple Ascending Dose Multiple Dose: Observed accumulation ratio (Rac) [Time Frame: 12 weeks]. Multiple Ascending Dose Multiple Dose: Peak to trough fluctuation (PTF) [Time Frame: 12 weeks]. Multiple Ascending Dose Additional Parameter: estimate of bioavailability (F) for subcutaneous administration at the corresponding intravenous dose [Time Frame: 12 weeks]. Immunogenicity for both Single Ascending Dose and Multiple Ascending Dose: Development of anti-drug antibodies (ADA) [Time Frame: 12 weeks].

Example 9: Phase 1B Clinical Trial

A phase 1b open label clinical trial is performed to evaluate efficacy of an anti-TL1A antibody on subjects having CD.

Arms: 10 patients positive for genotypes comprising at least one, but preferably three, polymorphism(s) provided in Table 1 are administered the antibody. 10 patients negative for the genotype are administered the antibody. Patients are monitored in real-time. Central ready of endoscopy and biopsy is employed, with readers blinded to point of time of treatment and endpoints.

For example, the genotypes may comprise rs6478109, rs56124762, and rs1892231; rs6478109, rs56124762, and rs16901748; rs6478109, rs1892231, and rs16901748; rs56124762, rs1892231, and rs16901748; rs6478109, rs2070558, and rs1892231; rs6478109, rs2070558, and rs16901748; rs6478109, rs1892231, and rs16901748; rs2070558, rs1892231, and rs16901748; rs6478109, rs2070561, and rs1892231; rs6478109, rs2070561, and rs16901748; rs6478109, rs1892231, and rs16901748; rs2070561, rs1892231, and rs16901748; rs6478109, rs7935393, and rs1892231; rs6478109, rs7935393, and rs9806914; rs6478109, rs7935393, and rs7278257; rs6478109, rs7935393, and rs2070557; rs6478109, rs1892231, and rs9806914; rs6478109, rs1892231, and rs7278257; rs6478109, rs1892231, and rs2070557; rs6478109, rs9806914, and rs7278257; rs6478109, rs9806914, and rs2070557; rs6478109, rs7278257, and rs2070557; rs7935393, rs1892231, and rs9806914; rs7935393, rs1892231, and rs7278257; rs7935393, rs1892231, and rs2070557; rs7935393, rs9806914, and rs7278257; rs7935393, rs9806914, and rs2070557; rs7935393, rs7278257, and rs2070557; rs1892231, rs9806914, and rs7278257; rs1892231, rs9806914, and rs2070557; rs1892231, rs7278257, and rs2070557; or rs9806914, rs7278257, and rs2070557.

Inclusion Criteria: Two groups of patients are selected: subject with the genotype described herein, and patients without the genotype.

Primary Outcome Measures: Simple Endoscopic Score for Crohn's Disease (SESCD), Crohn's Disease Activity Index (CDAI), and Patient Reported Outcome (PRO). If risk either positive group shows 50% reduction from baseline, a Phase 2a clinical trial is performed.

Inclusion Criteria: PRO entry criteria: Abdominal pain score of 2 or more and/or stool frequency score of 4 or more. Primary outcome would be pain core of 0 or 1 and stool frequency score of 3 or less with no worsening from baseline. Endoscopy entry criteria: SESCD ileum only entry at score of 4 and 6 if colon is involved. Primary endoscopic outcome is 40-50% delta of mean SESCD.

Example 10: Phase 2A Clinical Trial

A phase 2a clinical trial is performed to evaluate the efficacy of an anti-TL1A antibody in patients with CD. Optionally, the patients are positive for a genotype comprising at least one, but preferably three, polymorphism(s) provided in Table 1.

Arms: 40 patients per arm (antibody and placebo arms) are treated with antibody or placebo for 12 weeks. An interim analysis is performed after 20 patients from each group are treated at the highest dose to look for a 40-50% delta between placebo and treated group in primary outcome (50% reduction from baseline in SESCD, CDAI, and PRO).

Primary Outcome Measures: Simple Endoscopic Score for Crohn's Disease (SESCD), Crohn's Disease Activity Index (CDAI), and Patient Reported Outcome (PRO).

Inclusion Criteria: PRO entry criteria: Abdominal pain score of 2 or more and/or stool frequency score of 4 or more. Primary outcome would be pain core of 0 or 1 and stool frequency score of 3 or less with no worsening from baseline. Endoscopy entry criteria: SESCD ileum only entry at score of 4 and 6 if colon is involved. Primary endoscopic outcome is 40-50% delta of mean SESCD.

Example 11: Treating Crohn's Disease (CD) in a Subject

CD is treated in a subject, by first, determining the genotypes of the subject. Optionally, the subject is, or is susceptible to, non-response to the induction of certain therapies such as anti-TNF, steroids, or immunomodulators, or loses response to such therapies after a period of time. A sample of whole blood is obtained from the subject. An assay is performed on the sample obtained from the subject to detect a presence of a genotype comprising at least one, but preferably three or four, polymorphism(s) provided in Table 1.

At three polymorphisms comprising rs6478109, rs56124762, and rs1892231; rs6478109, rs56124762, and rs16901748; rs6478109, rs1892231, and rs16901748; rs56124762, rs1892231, and rs16901748; rs6478109, rs2070558, and rs1892231; rs6478109, rs2070558, and rs16901748; rs6478109, rs1892231, and rs16901748; rs2070558, rs1892231, and rs16901748; rs6478109, rs2070561, and rs1892231; rs6478109, rs2070561, and rs16901748; rs6478109, rs1892231, and rs16901748; rs2070561, rs1892231, and rs16901748; rs6478109, rs7935393, and rs1892231; rs6478109, rs7935393, and rs9806914; rs6478109, rs7935393, and rs7278257; rs6478109, rs7935393, and rs2070557; rs6478109, rs1892231, and rs9806914; rs6478109, rs1892231, and rs7278257; rs6478109, rs1892231, and rs2070557; rs6478109, rs9806914, and rs7278257; rs6478109, rs9806914, and rs2070557; rs6478109, rs7278257, and rs2070557; rs7935393, rs1892231, and rs9806914; rs7935393, rs1892231, and rs7278257; rs7935393, rs1892231, and rs2070557; rs7935393, rs9806914, and rs7278257; rs7935393, rs9806914, and rs2070557; rs7935393, rs7278257, and rs2070557; rs1892231, rs9806914, and rs7278257; rs1892231, rs9806914, and rs2070557; rs1892231, rs7278257, and rs2070557; or rs9806914, rs7278257, and rs2070557, or any of the above combinations in which a polymorphism is substituted with a proxy polymorphism, are detected in the sample by Illumina™ ImmunoArray or polymerase chain reaction (PCR) under standard hybridization conditions. Proxy polymorphisms are identified using linkage disequilibrium with a D'1 value of at least 0.8, or an $r^2$ value of at least 0.85. In some cases, the proxy polymorphism is additionally selected based on an independent association between the polymorphism and a relevant clinical phenotype of CD (e.g., stricturing and penetrating disease) In this example, one or more primer pairs described herein and/or nucleic acid probes comprising nucleic acid sequences capable of hybridizing the nucleic acid sequences, or their reverse compliments, provided in SEQ ID NOS: 1-41, or 57-59, are used.

A TNFSF15 profile is generated that correlates the presence or absence of the genotypes with a positive, negative or indeterminate result for a therapeutic response to treatment with an inhibitor of TL1A activity or expression with a positive predictive value and specificity of at least or about 70%.

The TNFSF15 profile of the subject is positive. Based on the TNFSF15 profile of the CD patient, a doctor determines that the subject is suitable for treatment with the inhibitor of TL1A activity or expression. A therapeutically effective amount of an inhibitor of TL1A activity or expression is administered to the subject with the positive TNFSF15 profile. The inhibitor of TL1A activity or expression may comprise an anti-TL1A antibody. The anti-TL1A antibody may be a neutralizing anti-TL1A antibody.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (364142 sequences)

SEQ ID NO: 1 - DNA, 1001 bp, Homo sapiens
cattctgcagcagggacagaagcctgggaagttgagtccacgaagagggttctcggactcccttccctaagcgagtgactgatgtttcctgactctggccctggttgtgccgtgaggccacagtgagggcagctggagagctcaggatctgccaccttagcacacatgggatgttaggcacttctcgctatgcctcagtttctgtggtctcatgaaggaacattagtactttcttcattaatgcacataaaatgcttggcagtgcttggcatagagatagatgctcaataaatgttggccactattattatagccccctacaaacaaggaggatgagattgaaaacaatgtttcctaaaaatgagggtataatgggcatcctatccatatttcaggggtaggaaaacagccttctgagatcatttatatgaagggtatggatggacaaatccttatcagcctaaaatattcctatctatgattgctatgtcatttctttargattaatcaatcctcttcatgagtcatatttcaatatattacacatacacataattataaaagaaccaagttgcataaaatttataaaatggagactaggaaaggaaaaacccgctcataaaacccaacaagagagcttaaaatgaaagtctgaaagtgcaggtaggtatttgtttaaatacttggtaaaagaaaatgttcaattcagtagctgtgacagacacaattttaaggggtgtgggcataagagaaacagaaagtccatctgtcaaaggggtaaatatttagtcaagtcttagatagtatttctgtaaacagaaatttcaatggaaaatttccaacctgagagcaaataatttaagatgggtttaatataagaattaaagctctcgtctccatgtcgctgcccagcctgagacccagccctctgagtccttgtggcagttcggctttttctttcttgttccctcaactacaactggacactataattttctttc

SEQ ID NO: 2 - DNA, 1001 bp, Homo sapiens
gactattaaccaatcatgaaaaacattttcaaataatacttaatgacaaggaaaatgctcacaataatatgttaactataaaagcctgataaaagtaagaattcagcataatcccatattttaagggaaataagtatatgtacagaaaaaagactgaaagacaacaaaatgtaaaattgtttatgaagactgcctgtggtttatttaggttatctttgttctttctatctttttatattttccagtaaaaatgagtttatattgctgtagaatcaggaaacaaaatattgtgatgcaaatatggctatgggactcttaagaaaaaggtttttatattgatttgagtatataacagagtaacatagcactaaagttcaaagtacaaggccaccatatgaatttgattaagtaaaggaaaagaattattgaaaacaaggatgcaagtaattactttttcatttggattgtttgttcaaaatgttgctgccaagttatctcacrttatttcagctaagctcagagagaccccaacctcctgagttcagcatgtcattggctgttctgttcctacacattgccctcttgcattttttcatttccctggcttcaactgcctagtcctcctaaccttaactcttgggattgacctgctgtgtatctcctatttttcaaaaaaatgctttatgcaagtttctaatacccaccaaatacactagtattgtacttcattcggtacagtgcaatcaaacacaggttgagtattctttatctaaagtgcttgggactggaggtgttgcaggtttgggaattttttggattttggaatatatgcatatacataatgagatatcttggggatgtgacccaagtctaaacatgaaattcacttatgtttcacatataccttatacacatagcctgaaggttaattttatacagtattttaatttaataagatatttaaaataacttatgcaatatttcaaatgcatgaaacaaag

SEQ ID NO: 3 - DNA, 1001 bp, Homo sapiens
gaggtgcattcctcgagagaagattgacagttgcttttgcaggtactggatatattagcaatccagaatatctttttttgtttttgttttcttgttgttgttgttttaaagacagggtcttgctctgtcatccaggctggaatgcagtggcacaatcatagctcactgcaaccatggattcctgagctcaagcaatcctcctgcctcagcctcctgagtagctgggactagagctgcacaccaccacacctagctaatttttaaaacttttttatagagatggggttgccccggctgatcttgaactcctgggctcaagtgtttcccctgcctcagcctcccaaagtgctgggattacaggcatgaaccaccacatccagtacaggatgtctttaaattatgttatcagtttggtgtttccagaattcttggagagtagaaattctgtccctaaacttgtgtgatggtaaaatacaaattcttaaacatgtttttctcccvtttactcagaggcaaaatcaaggtagacaagtttccttactaactcgttaagaaaggcaggatttttttttttttttagtattacccagtgtgtgactttcagggtctaagccttatgtaaaataaaaaggtctacagtcagacttcccaccttcattaatacctgagaaattaatgaaatagagaatacaaataaagaaaaatctatcaagtgtgggcactagattttgtctccttttctcctgaactaaaccacgtaaatggaatctccaggtccccagagactggcagatattccttaagcaaaaccgtttcaatgtccttgcttacctttctgaattcatatgttccattatttgtggtctttaaggatttctcttttactttttgccaggccagcaatatatttaataatctgttgtttaaaaaatatttacacaattataggtttttttaaatcaaaagtctcattatgattcctaagtctgccatattgctaa

SEQ ID NO: 4 - DNA, 1001 bp, Homo sapiens
taagttcaattataatatgtataggaataaggtacctcaatatgtaaaaaatcatcaaatgaactgggcagtgaaaatcaactggctttaactgttcatcatatttgagtcatttctctcaaactcaaacatactaaaacttcttcagcaaatccatcagtatttggttttcttttatatgctgataaaatcatagataatcttacaattgacatcctccaaaagattcaaagctgattcgaaccttggagttcaggttcctggcttctctgtctactgggggtcaggatacaggaagcacaaggaggaggggagaagattgtgtgggcaaaggggcagggaaggggccaccactcaccaccactgcaggacgaggcgctgagtaagggacggggctgctcccagcagaatccacaaagtagctcattctgctctcagcacctgtgtgagagaaggcgttggctgagcctctggatgctcacaggtttgtggattagaatmcacaaggaagacacgaaccttagaactaaaagtctccttaggagccaaccagttcacttctttgcatggcagggaaagcaatggaaattcagaaagatcagtgactaacccccagcaccggtaagagcagacctcagacagaaccagttccctggttgcaaggtaacatggataacagaccatgtctacacactgcagacagcaagcagtaaaccagtgcacaagaggcacatttttgtagggtttctgagcaggaaccagttcttgtgtgtctcccccacccacaaccaggcctggcagataagtaggcatacaatacacagttggggtgtaaattaattgataaaggaataaacatagaaaggattggagaaaggaaggatggaaaaagctctcctgaagaggtatgtcacccagtaacccaagaaacagataaacagagagaaaccctgcaaaagggattgagcattattgatcttgaaaaaaggagaagggctatt

SEQ ID NO: 5 - DNA, 1001 bp, Homo sapiens
gacctagaaggatgcttatgaaatgctaagtggaaaaaaagtgtgttgcaatatgggtcataagaaatggtgtcttttcttttctaaagagagaataggctgggtgcagtggctcactcctgtaatccctacaatttgggaggccaaagcaggaagatcacttgaggccaggagttcgagaccaacctgggcaacatagtgagacctctgtatccataaaaaatttttaaaaattagccagatgtggtggcacgtgcctgtagtcacagctactctgagactgaggtggaaggatcacttgaacccaaggaatttgaggctgcagtgaaccgtgatcacaccactgcacttcaacctgggtgacagagcaagaccgtgtctcaaaaaaaagagaaagaaaaaactatatatgtgtgtgtatctgcagaaatcaggttagaaatacacacattacacacacacatacatatgtgtgtgtatatatatataatttatttaatrctaacgttattggtaggttctttaaacattttttgaaacaaatgtggaaattaaaaaataacatgggctggtggggaatgttaatgagggggaggctgtgcacgtgggggcagggagaacatgggaacactatgtactttccactccattttgatgtaaacctaaaactgctctaataaatactaagttattaaaagcaaccgtgaggccaggcgcagtggctgatgcctgtaatcccagcactttgggaggccaaggcaggtgcatcacttgaggtcaggagttccagaccatcctggccaacatagtgaaaccccatctctacaaaaaatacaaaaattagctggacgtggtggtacacgcctgtaatcccagctcctcgggaggctgaggcaggagaatcgcttgaacccggaaggcacaggttgcagtgagccgagatcgcgccacggcactccagcctgggtgacagagagactccatttcaaaactaactagct

SEQ ID NO: 6 - DNA, 1001 bp, Homo sapiens
actgctagatctgacatacagagaagagcaattacagggctcttcaaagatgcaggtgctgccttcacaaacctattttgcaaggcatatatcaagggtattaaatatattagctgggcgtgatcaggcatgatggcacatacctgtagtcccagctacttgggaggctgaggcatgagaatcgcttgaacccgggagacagaggctgcagtgagccaagattgcaccactgcaatccagcctgggtgacagagtgactctgtctccaaaaaaataagtaaataaataaaaagaagttcttaagagagaaggaaaatgatataggtttgaaactcagatctacatgaacaatggaagagcgttacagagataacaggtgaaggtaaaacaaaacccaaagggtataatgggtttcccttcccttctctctttctacgaatgcagtgaaaggtgagttgtaatcatttctaatgatttgtgcacattcttataaatattaamttaattcatacacatgggtaaacatatatatattcctagattattattgtttatatgacaatttttaattctagtgaaataaagatgttaattttaatctataaaactacaaattacctaaaattatttttgtcccttttctacataaacttgttagaaaaaaattatgtgctcttcatttaacagaaatttgaaatcaagagaactgataatgctcttattttccgtagaaggttttggattgaccagtttgcgtcagggaaaatatttttgtgcttttcaccttcctcaaagctgacagatagttaactctctcctttcttccttggcatgcaggtttcctccatgttttaggtgggcctagagatgtaaagtcatggcctttttcaaaagctacaagctgagccaagcatggtggctcatggctgtaatcccagcacttttggaggctgaggtgagtggaacacctgaggttgggagttccagaccagcctaggaaa

SEQ ID NO: 7 - DNA, 1001 bp, Homo sapiens
acaaatggggagggcctgtgtcctctacaaaggagtccccgtagaggaaccccttccacagggcaccccttccacagggaggggctgggccagcagccgtgcgcagtgggattcccgtgtctgggggcttcagtcttctcaggggacacacgcccaagaggcagggagcttgggtgggggctgcacagctgtgggcttctgttctgggctgctgctgcctagtgctgcggcttctgaagtgttacccagcctcagagttcagccctcatctgtaaagtaggtttaagaaaaccgactccaggtgaagaaaatggagcaatatgcactgggcacggcacccattcctgttcccagagaccgcggtggttctcactgtgcggcatgtgcctctcacctcccctcccttccaaccacctttcgggtgctgagccgcgtcgaagggactttttgtctcctacctcagaggctctcccaagccagccctggccccactgtcgggcwcagctcagcacgcaggcgccgggaccttacctgtctggctgccgacagtcaggttctgctgcagaagcacgttctctatgcagcagccaatgttcacgctgggggtccgtgcgatcctcagcacgctgaccacgtcatacaagccccgcatgttcaagaagacggtgtcattctgcagagcctggtccagcaggctgttgtccgtcttattgatccagtacacgttgggcctggggtagccgtttatggatgtacacgtgaaggtgagctcatcctgggaggggctgtggggggcgctgacgacgggcacgctgaagtttgctgcaggggagggaaacagattgtgagagatgccagaccctgctggtcaagaaacagagggtacacggtgccaaggctgggtcagaggggaggcggcccattgtgccccgacatgggtgacaggccaggaccagggctgtggtccgagcagcaggctccgccctgtcctgcccaagagt

SEQ ID NO: 8 - DNA, 1001 bp, Homo sapiens
caaagaaggttttatcttcttttgtgtaatccaccaaagagatgtcactgacgttcaccattagcttgtccccttcttgcaaggagaacatggctccgaggtagatgggctggaaccagttgctacctacttcgcatacagacttggtccccatgaggagctgggttggctcagggtagctgtctgttaccttggtgatgaccacagtgatggagtctggcttgtttggtcggcctgcttgtctgatttcactgcactcagaggtcatcccacggaatgtgacctgggagtaaatgaagtagtctcccgactctgggatcagcaggaatttgttggtatagttcattcggttcttggtgaaggccaggcctagttcatgttcccagtgcagagctgggaactgatttttaaagtgctgtgtgggagtttgtctcacaactggaaagacaagaaagaggattaattttctcattgggaaactgtagactttgcttaaaaaghgtctcatatcattttcaaaatagactaaagtgatcgaatatacctaacagctaaaaactgctttggggaggaatgaatgaagaatatgtgactggacatacacatttgttcaaagagaataacatcttggactagtgacctggggcaaattactttgcctttctgagactgagtggtctgacctgaaaatttttaattttacctgagacctatgatcctggagaacaatgaaggttaaggaatccccctattcttctgtgtttaggaaaatggcttgctgcaagaattatcctttcccaaatgactcagataaaactcatcgatgcctctcttgtttacgtatgacaaggccaggcaccagacccttcaaattcccattctttgccccataagtgattggctgaactgttttatccccattcatcaattggaacaaaacacttgtcttacaggcatgaggtaagtgatagaaacttggcatctccctggtcctaatcctc

SEQ ID NO: 9 - DNA, 1001 bp, Homo sapiens
ggtcatggtggctcacgcctgtaatcccagcactttgggaggctgaggaaggaggatcacttgaggtgaggagcttgagaccagcctggccaacatggtgaaaccccatctctactaaaaatacaaaaattagccgggcgtggtggtgcacacctgtaatcccagctactcgggagggtgaggcaggagaattgcttgaacctgggaagtggtggttgcagtgagccgagatctcaccactgcactccaggctgggcaacacagcaagactctgtctaaaaaaaaaaaaaaaaagaaagaaaaaaagagttatattatttacgactcttttagcttcactttcttataagattgttgtgagaagtgagtaagacacatgcaaagtggtaaactgcctggctgtcataaaagtcttggctactatcacggctgggaggcaaaggagattcagagaagggcagaatgactgcataaggtgatctgcctgtaactcgtgtttcytcctttctagtataaagagataaaggacttcaaggtcttaaactggtgagggagtattacagcctttgtatggaaaggtttgactttgtgtctctgcttaaacccccattgtgttgcccctaccaattattgtgctgcccccttgtggttaactgtgctaagacctttcttttgctcttctcccattacatttcccacccttccccactcccttttagacccctcctcttagctcccagtttcccaaactgtgtgccaaggtgcccagagcacctcaggcttgaacttgtgttttgagttggttcatggtttcaatattagatacctacacccgtttctacaatgtcatgtctttgtaaagatgtattttcagaggttgctccgataaaaagcaactactacatgaaaatgaatgtagaacaggaaatgacagtgtggtattgtccaatttgattctaaggtttgataagttctacagtgctctacactaagttgtaagg

SEQ ID NO: 10 - DNA, 1001 bp, Homo sapiens
tgagcaggtgcagcccacgctgtcaggaatgccctgagagcctggcaacactcccgggactcaagaaggcaggtgggataagagctacaagagaggtgctaatggtaccactgttatcatcaaagagggtagagtagatttcccctcactgcgcatctgggacaccttactggaggaggtggcatttgagctcgttttgatgagatagcatatattttaatcaaatcatgtgtacctgaatcaggtaacttatattttgatattatgaatcaggtaacttatattttgatattatgatccctccaggaaaataaaaactagaagatggtaatagctcacatttatggaaggcgacctatacagcaagcttttcacatcatgtcctacgtatctcatgaggatgctgagatgctcaggggctctgaaacatacccgagggttcacagtgagagggtggcagagttggaatttgaatcctggtaggtttgttcccaaagagamcctggcatattggattataggggctattcctgcctgacagatcggacaggtagtggaaggagaaatgcagctcagagccccatttaggaggctggttgactgcatcataagacaccctctgctgaggcttgaaatgcattgttcaaaacagtttacagccaattttggtttgcctctgatagaaggagctgaacacaattttgattatttgctttaattcaaatcaggttaacaaaatcagtatattagtgcaatttaaggacctttttccccctttattacataagctagtggacttcccatctgatgtatgaaatgtcactttgtctttaattcttgacgttcacaaacactggtgctactggaaaaggagtgggagtgagcgtatgtgtgtgtgtgtgtgtgtgtgcatgtgcatgtatgtatatacacatatatatgagagtgaaaaccaaactgaggtttcagatggactttagaaggattgagcaggttttgaa

SEQ ID NO: 11 - DNA, 1001 bp, Homo sapiens
aaagatctccagattgcttgtcccgcaaattcctagcatcctcctgtactattggatggactgttaggaagttgacttgtattacaaatgcatactgataatttttttttaaagttgaaatgttgatgtgactacctgaaaagagatctttggctgggtacagtggctcatgcctgtagtcccagcactttgtggggtcaaggcaggcagatcacttgaggtcaggagttcgagaccagcctggccaacatggtgaaaccctgtctctacctaaaatatttttaaaaattagctgagtgttatggtgcacatctgtaatcccagctactcaggaggctgaggcaggagaatcccttgaacccaggagggggaggctgcagtaagccgagatcgtgccacagttgcactccagcctgggtgacagagcaagactacatctcaaaaaaaaaagagagagagatcttgggaatcagataggtgcaattcctaccaccattaaaktcagagtaaaactgaagtatatttattagtcatttctacctcttatatacaaatatgtctggcagttgtgacttgattttgtttcttttctcctaagaaactcttttactcactcgctagtatcattaagaggtatgaatcaacatcgaaattaccagacttttaaaatagccctctttttttaaaaaaaagttgacgttctatttttgtttaaatatcccttttgatgtgctaactaggttagtctatcacctttaatgaaaacttgaatttctaaaggtgcatttctaaagccaagaaaacaagtaggttatgacaaacaaacaaacagtggaagtgatgctatgcatcaactgttctccagagaagtatcaataaattgcttgtagttatacaaatgcagatgcatacattagagatttccaaaatacaaaataattaagcttgatgaagactgatattatatatggcaaagggaaatatttaggcagtgtcatctt

SEQ ID NO: 12 - DNA, 1000 bp, Homo sapiens
ttctttcttatttatttgtacattatctgtttgtatccttgaattttctctgggatgttataaaagaaaaatattacaagcataatttctgacacaatgttttataactgttttcaaaagcaatctatttctctcttaatttctatagaacccattttagtcattcctatgatgaatgaaaaaaaactcacaattagttgtcagtttcagaaaggagtctcagaagcatcttagaaccacctaggcggtcttataggcgtcacagaaaaatattccaccttacttattcttatcttcttcaaactgactccaaatataataagcaggcttaagttatataaggttccttaaaagttgttctcaaaaacaattaaatgcagactgtcctcagtaaaacttgcattggcccagtccattttaccaagtttgctccttcttacatgtacgactgcccctgtgacaagtttaagcctacgttaattaatcatctttccataacaygagacatattcatccaaccctgagagggataaggggtaacaggcaagatatattcaaattgtgacatttaaggtcaacttgactttaaaactcatatactgctcagttttcatatacgtggctgaaaacaagtcatcacagagaactggtcacactgttagaggaccaaaatagtaaaatatgaacaattcttccatatttaatgatattaaatataacaggtcctatgtctatgcaattgaagtcaacatgtcactaattagggcttcctttgttatcaaacttgctgagaagatagaacagtgaggaaaaaatagcaggaattgagctgtacagaattaaagacattcttatgaaccttaagacttaaggtcagtcacactcatatgacatttggactattagacaactcttctgacctcaaattttgctcttaccagttggtgataatcctttggtaagagagcatgttaaaagtaaccaaatcagataaggacta

SEQ ID NO: 13 - DNA, 1001 bp, Homo sapiens
ttctgagcactcacattttaatgctgggaattttatgctgaggttcagtgcttttcagggagccatgaaccccctgcaatgacttgcagactgtaggtattacatgtaaaacttgtgtgagtaatttcctgaagaaggggtttcattcttcagatcctcaaaaagatctatgatccggccaggcgcggtggctcatgcctgtaatcccagcactttgggagaccaaggcgggcatatcaggaggtcaggagatcaataccatcctcgctaacacagtgaaatcccatctctactaaaaatacaaaaaattagctgggtgtggtggcgcatgcctgtaatcccagctactcgagaggccgaggcaggacaacagcttgaacccaggaggcggaggttgcagtgagccaacagagtgaaactctgtctcaaaaaaaaaaaaaatatatatatatatatatgatcctaaaaagacattgatattaaagagtaatgatggggaargaccaccaagtgatcatttataagatgctgcgagaattgctaaagttgagggatggattctgcattccaggagaacaaaggaggtagatcccgattaactgagtagcaggatattgagggaagcttcttgtaatgattcagctgagtcttacacaatgaatgagacttggatagatgaacatgcattaggagacatcagttctggtcagaggaaacagcaaatgcaaaggcccagagccataagagattcagatgcactaaagaaatatcccatcatttaggatggtcggcatatacacagagggcctataaggaaggagaagaaactgaggttgtagaagctggtagggactgcatgctgaaaggcattgtaaatcttagactaaaatctgtgggagactttgaacaacctaaagattttaagcagagtgatgcaatgcatttgtcttttgaatgcaaatattgctggggcgggtcttttgtgttatcagctaatgatt

SEQ ID NO: 14 - DNA, 1000 bp, Homo sapiens
tgtaaacttattagtgcctctgcacaccatataattaagatcaaattctccaagggtttaaaatagggactgctgctattgtgctgctgacagcgctaaggaacagatatttgccttttttacatagacggctctgccccgcttttgctgaaattcccactctcacagggctgggagcccagcagggtttacctggaccaatgaggggggctcactctgctgggaaatttgcttttatagatggcaccaccaacgctgaaaacatggaagtggaggcaaacattccagagcatctactgtcgcatcccctagaaggggactgtggtcaaggcagatcagtagacagaaggctggaagggaaatgagccccaaggaagaggctcagatccagagcctgtgtcttggtgagactccaacagaagtgcctcgaggctggtgcttcagaaggaagtgggtgtacagctgtgtaagtgatctgggtcatgaataaacaaatgaacmcaggaatgcatgcaccatgagagcctggaggggactataagacagacaacgggtgatctgggcacaggtatcaactgctgaacgcccagtgtgtgcgtggaggaggaagggggtcagaaaggcaaggaggatgtaccagtatggtagagacgagcaactgtgggcaaggggtgctcaggatgcatgggggtgtggagagaaggggagagcaagaaaggcttccaggggtgaggagccaaggaggtcctgaagacagctaggagttagcaggcagaggaaggggatgggcatcccagggagaaggaacggcaagaacaaagcagcacagccgtggagagcctgtcagtgagcggagagcccgtcagtgagcagctcgcctgggttccagggaacagggccagaatttttggcaggatagactcaaaggcctgaggtgaacctgcaaacaaaggtaaaaacactaactggttttaagcaggagagaaatatgatcagattt

SEQ ID NO: 15 - DNA, 1001 bp, Homo sapiens
tcactgcaacctccacctcccaggttcaagcgattctcctgcctcggcctcccgagtagctgggattactggcatgcacatcatgcctggcaaatttttgtatttttagtaaagacagggtttcactatgttagctaggctggtcttgaacttctgacctcaagtgaaccgcccacctcggcctcccaaagtgctgggattacaggcatgagccaccgtgcctggccaggggatgatctctttctagaaattcatatccttcaattctggaaatgtttctcatgatagttctttgataactgaccctccttccttcactgtatttctctttctgggacttttactagtcagtgtatttctgggttggtctctctcttttctcttttattggcaaccctgatctaaggaactaaggtatagaggtggttgagtcctgaccagagccgtgagggtctagatttatgtaaatgatggagccatacacgttactttatttatagyaagatattgtaaagattttgaaatgtcatttatatgaaatgtcaagattattaaattcgtagttcactgtaacctcaaactcctgggctcaagcaatcctcccacctcagcctccaaagtagctgggactacaggcacatcccaccatgcccagctaatttttgtattttttgtagagacggggtttcaccatgttgcctagccttgtctcgaactcctggactcaagcaatcctcctgccttgacctcccaaagtgtggggattacaggcactgagccactgcacctggtcaatgcatttttaaatatggtctaagggtatcagcaagttgcagatttgataacagctgggtcttttcatttagtaaccacccttttttcctcctctgtactctcacacaatattaaaatacctcctattaaatctctattatcctcttctcttcctgttgcatttttctcccacaacttaaggctcaagtctaagcagtgaaaacata

SEQ ID NO: 16 - DNA, 1001 bp, Homo sapiens
ataaattaaaataacagataacatgggctgtttttgacaggaatatattttagcttctgataattagctttagtaatcattagcttagttaatgaaaaataaaatacttataatattaaaaatatgagaagctaaactatgagcaactaacaaatcaaaaccacgttcttctgaattcctgactcccccgcaaatagttccaaatcactatagtattcacatagccctataataacctttgtggataaacagtgaattccatgttcaatgtaaaataacacagaaatttagagttttaattgcaatgtcctatgtaaactttaaaagtttccaaagcaattttcataaatgggattccattttccacagccaaaatactatactgacactgaccctcatgaactgttacctatgcatttgtgtgccatttacttttaattacaaaatttctccccttgattaaatttattgtatgccttgcaatatatcaaaatgatagawtaaatgtataaataaattattatttataacaaaattgaagcttgtccttggaatcattttcttgtagttccatgtagctaaaatggggctttgatttcaaccttgcccctgatgagctgtgtgatgaaatcttaggcaagttactcaacctaagcctcagtttcctcatctgcaaatcagggaaaataatacatgctttagactattattttgagaattaaatgaaatcatgtatacaaattgtcaaacagggcacagcatactcagtaccttatcattgtttagtgttgttattttgtatctacagtgtttttggaaaatagcatgattaatcaattgactggaagacacacagtctaacagacaatatatagaccatttatattggccatgaaagtgtccataatggctgacttaactggctttaatgtgtaaaatatggtgactcccatggtttttaagatatggcttaaagtagatatcaatttctttacattggt

SEQ ID NO: 17 - DNA, 1001 bp, Homo sapiens; identical to SEQ ID NO: 5

SEQ ID NO: 18 - DNA, 1001 bp, Homo sapiens; identical to SEQ ID NO: 6

SEQ ID NO: 19 - DNA, 1001 bp, Homo sapiens
ggcaattccagtgaaataattgtttgtttgtttgttgagacagggtctccttctgtcgtccaggctggagttcagtggtatgatcttggcccactgcaacctccacctcctgggctcaagccatcctcccacctcagcctcccgagtagccgggactacaggtgcacaccaccacgcccggctaatttttgtattttttgtagaggcggggtttcccagcgttgcccaggctggtcttgaacccctgagctcaagtgatctgcccaccttggcctcccaaagtgctgggattacaggtgtgagccaccgcgcccggcctgaaacaatcgtttctaaatattggtgtgggccacacagtcatgtttggacctacttgtggccttttacagaccccaggccaaggctttgggaacttggctgtcagcctcctgtgccttctgcacccccaccccatttctgctttctggaacccccgatcctgtcctgttctgtggtgattcrggtgtgcttgggctctaggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccaggtgcgttcatagccagactgcttggtcctgaggcctgcgctgctgcagggtgagccccacccggagttcagcacggactcccccagcccaggtgcgttcatagccaggctgcttggtcctgaggcccgtgctactgcagtgggcagcctgccctgtggctgtgtgtggtcggcctgggcaccatctattcaggctggcactgcagggcatccgcttctctcagaggcttcttgggtgtgaattcttcagggtcctgtagcctgtggaagggctggtattgttcagtagttctggtattttccaaagacctatgtcttctcccagccag

SEQ ID NO: 20 - DNA, 1001 bp, Homo sapiens
gttggtggatttggcctgcacggattctgtgtggcctcttccttcccctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccatgttggtggatttggcctgcatggattctgtgtggcctcttcctttccatgttggtgtccttttttccatgccaggaatcctggttctcaagggcggggttgttggcacgagcgtgatgcagactgcctttgctgcctttctcttgcccagggctgaacatggagctggaagacattgcaaagctgaagagtaagtgttgccctcccygcctccttgcagctgggtggggcctcctccttgcgaggaggtgggtgacacctcctcgacccacagtgatcctgctgcgcctggagggggccatcgatgctgttgagctgcctggagacgacagcggtgtcaccaagccagggaggtgagaggcggggagccagccccttcactgcaggcccagcctagagctagaaacgggccatggtgcagtcctgggctgtcacatcacgagtgaggcctgttttcaggcctgttttccctttttgagacctgggaggagcacctgctttgcatgatctggttgctgagatgttgagaggagcagcacacactcccacgggacagcacacagccccccacggaacggcacacacacccatggaacagcacacacactcccacgaacagcacacacactcccacgaacagcacacacactcccacggaacagcacacacacccacggaacggcacacacacccacggaacagcacaca

SEQ ID NO: 21 - DNA, 1001 bp, Homo sapiens
aaaaaaaatccacatcctaactcctggaacctatgaatatgttagattacatggcaaaaaggacttaaggctgtggatggcattaaggttgctaattagttgcccttaaagtagggagactatcctggactgtggaagtgagccctggattatgaatgtgatagggaagcagaagcatagagaaactatgttaccaggtttgaaggtgcaggaaggagctattaaccaaggaatatgggcagctctagaagctggaaaagcaatggaataattccttcctagagcctccagaaaggcacacagccctgccacaccttgatcttagaccaaggaaacctgtgtcagacttctatcctacaaaactgtaagatagaattgcgggttgtttagggtgctatttagggtaacttgtgacagcagcaacagaaaagtaatgcactttctcaactttcctctctcccttctcccccagaaccaaacactgctggctctgggctctcrcagaacactgtccttacagtatttaatgctcttgatactatctggggcctggccacgtgcatcccatccttcccttagcttctccaggagcattgtggcttggtgtcacgacctatctgaaagccttaaccctgccaccacccactttctgctggaaggacaggcactgtgaagtgaaaggacccacagcccatgaactggaaggaacaggaagggcaggagaaagaagaaataagaggagagcagcagggggatgcagggaggaggaggataaaggggttaccagaggagaggaggtgagaaaacagagggaaggaatgaaggaggaagacagggtcaaagaagaggagaaggaaggaagggcgctggaggaggacacagaagctagggtggcaacgaagaggagaagggagaatgaagagaaaggaccttgttctgcccccacccatctcccacctgaacaccctctcctccctcctccctgagatctcccccagcct

SEQ ID NO: 22 - DNA, 1001 bp, Homo sapiens
aggaaatttcatagaaaaggaagggaaacagtgacactctccagttttggcctgagcatataaaattatttgcctctgaagccctgagatcctaggccaaaataaaacaaaacaaataaaattaaacatcacgataacttcaaagccttcgtttctacataagcaggaactgaggaggaaactgaagcattgggctgcctaggtatatgatcattgcaatgtctctaggtggatggatgagtgcctggggagcagcatagactgatctcttgcttctacttctaaatcatggacttcccctatcatctacctaacaatgttggaccctgcaatttcaacctgtgaattttgtgatacttattatatgcagttttcaagctctctttagtttgctttttcttaggtggagaaaagactcattcaagttgatgttgatagtggatatcaccccatcagatactatgatcataagattagagcttggagagccccaaagagtayctggtcttctttttcaagctgaggatacagaaagcccagaaaaaaacatgatttgctgaaggttacctacatagtgagtaaatgcatgagaatgagaagccaggtattttgctttctgtgatcactcttatcagaggaaattcttatggttgcacttatgacagctgcattaagagtctgtacaatggaaagctttggaggagctgttaaacatatggagtctaaggaaatgagagtcagagagacggcttcaacttatcccttatctataacttggcagtagagctttcaagagctccaaccgccaaagctatggtttgctttctgaattgctgaaaccacagtgaaaaaggagaaataacaggagtgtacagatttttctgtgttctttggctttcacatttatctggtccaataaattcaacaggtatttcactgcaagttgaagttgaatgataatgtacaactatgaggtatattttctcagccatttctctgaa

SEQ ID NO: 23 - DNA, 1001 bp, Homo sapiens
ctccactgtagctcaagtgtcaatgcttaatactgcttgattttcctgaatgatttctctatcccccaaagtaaaatgtgtaatttccctttttccgactccaatgttcctgcacttactgccaacataccactttaaaatactctaacatctgatttttttatttcccattacatatctattacatatctcttgaagacaagaaatcatttgtatttttatatcttgttttcaatatttaaatgacacatgctatttccattcccaaattaattgataaatacatgaataaataaaatagctgtgccatatagttatccttgatatcactctagatgaggaaactgaggctggaaagattaaacagcttaagtaatattaacaaagcaaataactcttgggacctccttgctctgtgtatgtcaaagctcatgctctctttcaactccattacatctctttgaatcagatagtaagatgaaacctcttctaggaagtaargacttcctggccccaatcaattctttttacttgccacctgcttgtgaatattaatattgctttcgctggattttaaaaagtagactcctaggtaaacagcaaacaagagaggcagaggccagaatgctcagaaaaaaggatacaaactggcgcaataaggattatatggtctgaagcagaggtatgtggaagctgaggtgggaaagtgatggtaaagcaaaccagacccaaggatattggtttatcttatggcaatacttaacccatggaatgagaacatttgtatgaattatccatgccattgttttcctccatataagatatcatatttcccatacgtggtttggagagacttcctggagtagatcgattccaagtgtatcttgaatggtagggaaaatatggcttagtgtttggaaaaagggatctaatttgcagacttcaaggccagtgagattgaaggagctgattcaaataaaaaataggcatacttgaagcaa

SEQ ID NO: 24 - DNA, 1001 bp, Homo sapiens
ttagcttctgcttgagcatttctactcactggagttcattactttctgaaactgtttcctgttgaacagctttaatggttagaaatttctttgttatactgatcccaggcatgcatcacggtgatttctaataattgacaaaattattccccagttttcttaatctcttctctacctgacctggttcatagtaatatatttatattcctcaatatgcattctactatagcaatatttattttttcattctcattggagaattgtggataatgtattgacttcagaaaatatacatgtgtaatcagtatacaggtagactactgtgagggccaccttagagggctgtttttggaagctcaggatccaataaatctaacacccaagacccatgattagctcttcatgggtagttgaggtctttcaggggggtttatttttggttagttacctatcttaatctttttggttcatatctcttatggggagagaggtagggagggrcatggaaaatatcctatcaaacctccatttataattgtgctcactatcttataaataagacaagtaaatttttctaaaacttcggaagttttcttgataattatatagtcatttaaggattaatgaattctctaaagtttagccagttatccatattaatggtagctaaaaattgagaatgccacaaaaatttcagacatctgactttttaaaaattagaattttttggcagggtgtggtggcctgtaatcccagcaccttgggaggccgaggcaggcagatcacttgaagtcaggagttccagaccagcctggccaacatggtgaaactttgctctactaaaaaatacaaaaattagctgggcctgatggtgcacacttataatcccagctacttgggaggctgaggcaggagaattgcttcaatttgggaggcagaggttgcagtgagccaagatggtgctactgcactccagcctgggtgacttgtgactgggcaac

SEQ ID NO: 25 - DNA, 1001 bp, Homo sapiens
ttttccatcaggctcagaaagcagagtgacataaaagctgggtatgtgctaaggaggagggggagggaaagtctccaaataaatcatttaactcacagagtttaagactggaagattctcctgggccttgtaagctataaaaaaaagcagatctctgtcaagaggccttttctctaaagcagttctgactcagcctatttgcccttggaagatgctgcagcacctaagacatccacaggccatcagtcaacacgtgatctcctctctagctatgctccctctagaaatgcaggatcttttgccccatcctaaactcagaaaaggggtttcatgtgcagaacatggtggagaatcctaggtctctgactcacaaaaggatcaccttgggcctgagcttcctcatctatgaaatggggatgggaattcatgccttgctgtataattgcaaggattctatggagtaataaaggtaagcgtctggcatggtttctgtacatctcsggtgctcctggtactggctgtcacacaggtcaataaatatcatttcctcctaatctttccacatgcatagttattggaaagctgggtgggcagcaggctataatttttattttgcccaaaaaggcaggaccttattttgtttatagaaggcagaacctctttgttctgcttgaaacaaacaaacaaacaaaaaacctctccaaaggctcttttcatcctctgctaaattggacaatccagtcggtccctctggagtggactcagttgattgcctacccagcacccatttctccccaactccctacctcctttttatttctcctgctttatagaactctgatttcatacagatatattcatgttcctccctggccatgtgcctcaaggaaggtaatcccactccagctccagggggttttctgattggtctaagacttggttctcaatctcagagctattgatattttgggttggatttttttttattttttatttttatt

SEQ ID NO: 26 - DNA, 1001 bp, Homo sapiens
  modified_base (501)..(501): a, c, t, g, unknown or other
ctatctggtggaatttgaaatatttgtgtgatccaggcacctatctttaaaaaggatggagtacttgaccttccatccttgtcccatggcccttcttcctttgcttgttcagtcaagccaaatcccaccacgtctctatcattgtaaaacttttcagggagaaaacctcaatggaaccagggaaagcatacctaccaggtcttttacttttactttttttttttaaggttgagttccacacactgttggtggcacctaaaaaaccactgccaccagttgaaaagttaattatggattaccccttgaaataaaatacaagttttattagaagtggagggataaatcaaaacagctggagggggaatgccatgaaactgctatgacgaagcccatgatgttctacttagagtaaacattctttttattttattttttttaagtcctgggtctgctgtgtagaaagtcatcatcgctttcatgtgggacaaaagaggatttggnaagggaatttccttaaatctgtgcattgaaaatgcagcttatgggagcctaaagaaaatacgttttgctttttcttacagtgggtgcctcttaattgtgacttttataaaccccttctgtagctatcataaccatccaattatctaacttcattttcgtatgattaaaagagcctctcttgccgaacatatgacaattattagaacgtttctaaaatctttttttctagtgatatgaaactcctgtagataaaataagtcttgatttatacaatcctcaagtacatgtgaatgttatgtctataaataaatactccatagtagatgcaaaatccctttataagtaacaatacattggcatattcattgaccaaaaagccttgtgatgttaatgttaacaaaattaaacttcagccatttcattcaactagtaattcctgagttctaaggactaggcactatgctaggcagggaagctatatatgtatgtgtgtctgtgcc

SEQ ID NO: 27 - DNA, 1001 bp, Homo sapiens
  modified_base (501)..(501): a, c, t, g, unknown or other
accatccatggtgagcggctctaactttcaatctggccagatcattttccccttgtattaaaattgtcctggaaaaccattaggttgattttcaatcatcacagctaatacattccttgttgcaaatgccaagtattctgcacttgcttcagtttttcagatcttctctctcatattcagtacctggggtgaaatccatgcctagtaaaacagcccttttgtatccaggccaggatgcatctctgagacttgaatgcttttgctttctctcctgttttttgttttgttttgttttgttttgttttggttttgttttgttttgtttctcttctctgcctgatcaatactttcccatctgaagaagcaaaacattctctctcttctgtttcccttgctgctgattctggctcaaggggatgggggcaggagtggaggaaagagggtcagagtctatatttaaccacaaagataattcctccttgacagcagctccagagagantttgacatttgaggggactgagtagcaagagtaatttgcatttatctggctatagaaacagaagagattgggagcaacaagtgatctgtggaggtaaaaatgagtcaggggtttggaagagggaatatagggcaggtgaagaagaagaaattatttgccaacaatgatggaaggataaagaacaagactcctgaaactatttccttaaatgtcacactaaagcaactccaagaggattgtaatagctttggagtgggacaagtggcacagatgggaaggctgacatgtcccggctgcttaaatactctgaattctagatctgcatttatcaaaatttaatgtacacccgaattgccctggatcttgaataaaatgcatatattaattcagtaggttggggtgggccccaagattttgtatttttagcaagcttccaaatgaagctgatgttggtcctgggaccacactttgattagcaaagctctgctagagcgttttgg

SEQ ID NO: 28 - DNA, 1001 bp, Homo sapiens
  modified_base (501)..(501): a, c, t, g, unknown or other
atattctttcctgtctgctgccttgtaagacgtgactttcgctttctgccatgattgtgaggcctccgtagccatgtggaactgtgagtccattaaacttctttttgtttataaattactcagtctcatgtatgtctttatcagcagcataaaaacagactaacataacccccctttcttcctacccctgtgatttgggtggatattaaaattttgcaagccgccactctagagaagtaccactcaaaccatggtctgcagactaccagcattagcaaggcctgggagtttgtgagagatgcagattcttggtgcccatccaaacctacagaagcagaatctctggtggcaggaaccagcaatctgtgctttcaacaagctctctgagtgcttcttctgaatgttaaagtataagaacctctgctgcacagggagacctcactttcattattctcatttcacagatgagaaaaatgagtcagtaggaggaaaagtgattgnctcaagtgcttaataagtgtctaagctaggatttgaccctagggcttgtgaatctggagcccatagactcaactcctgtgctatactgcctctgtgtctttggtctgtgttctcttctttttttttttttcttaccaccctccaaaattcttatttatttattttctatcaccgtacttactggtggagtggaagtcccttggaagtgggggacgtgtctgatttgtgcatggctattttgcgatttgccattgctggaatatttagcaagcatcaatgagtcctggagggcttttaaaccatagatgatcagggcccctgcttggtctaggatggagcctgcaattttgcatttgtgacaagctcccacggatgctggtgctcacttggcatagcaaggggttatgctatttttcaaaggcaagagaagtgtgcatgtacttgagaggagaaggggtcggtcaccatttactttgtgcctcttgctacccttcgttgcc

SEQ ID NO: 29 - DNA, 1001 bp, Homo sapiens; identical to SEQ ID NO: 4

SEQ ID NO: 30 - DNA, 1001 bp, Homo sapiens
cacgccgcacagctgccaccgccggccctggcccgggagaggggggtctctggggatcttagcaggccatggtgggggtgtcttggggccagcctgaactgaaagaccatcacagcttgcaagccacctccctgctctgttgctggctctccttgaagacaagtgtttttcaattaaccaaagcggtgcatggcaatgtgataggggaatgaaacacagcaacagaatcaatgccccacgctgggcaatagccgactttctgttcgctcccatcccttccttccctccccgcctccttcccctgctccttccattccacaaacatttattgagcacccgctgtgtgccagccactgttctaggccctgaagacacagaagtgaacaaaaaaaaagagtccctgtgcacatcctggagggactttccccgtgtgtgtgtgtgtgtgtgtgtgtgtgtgtctatacagtgtatggagacagtggataataaaagctgtttatsaggcactttctctgagctgttccatgtgcttcacttatactcattcagctaatcctcaggacacccccgtgaagtcagtgatattagtcacagaggcccagagaagtgaagtgacttgcccaaggtcacacagccagcaagaggccaagcccggattgaaccccagccgcctggctctggagcctgcagcataaccacagcagggaactgccaccggagacagacatcgacagccactaggagatgttaaccaacaggcttgtcttcacggcacggcccccgcttcaccagctgcactgtttgatgagctttgcaggtcccagatcttataagctcatggtgattgatccaaatgatgcagaggtcggcctaaagttagaagtgggcccctctctgccccaagacagcccttcaccccaattccattcccacagtttgggcatccacccaggctgccaagccaagcgggggctgcccgggttagcagggacctggccatg

SEQ ID NO: 31 - DNA, 1001 bp, Homo sapiens
ggcagcaaattcccctcgtgactccaatgcccctgccatcttgggtctgggagcctttgcaccctgcacgccacaggctcgccacctcctcccgccagcccccaggatgccttccccacgtgggggcccttagtggccgggaccactttggtagcagtgcttaccccagccccccaaaccatcagtttctggggccagctccccatgaagcaagagccccaggagcagggacatctccttctctgatgtccctgcacctccaaggtctgggagacgctcatccctcttctctgtggcctctgcctgggaaagcttgggggctttgtaagtcaaaggttggtcttgtgggaacctcccagtgggctgtccctgagccctggagccacagaaacccctgccccacccacgatggctgtcatctgagtctgcatggaggtgtgtctgtgccaagtgagcacacatgcaccaaggcggcccctggccaccaggggctcttgaagyctgcaggcggcccttcctctctctcccactccccctgttggggccaccattctggctggcaagatggctgtgatggcctccagcaggccccctgcctccacccttagccccttcaagcatttccccagagccaccatctaaacgacagctgtgagaactcctctgtgcccccatttgtctcccacagtgcccatattcatcaccagcccacaaggcccctcctgtctatggaggcctcctcaggacatctgggggcttcctgggccagggtggggggtgcctgctccaggctgtttctggcttgtcccctccctgggtgctgcctaagcagcggcctctgtgtcctttccttggaccctcagcacccctgcatctaacctacccccaccccgagcttgcctcaagacccagcatggacagggccgcctacctgaaggtgtgggtggcggagggctaagacatttgggagggctatgacattccgggacctttaaattctt

SEQ ID NO: 32 - DNA, 1001 bp, Homo sapiens
atatattgatcagttgatgaaaatgttgtgaccagggctctcaggaacttaaccatatgtttccctggagtgatggttcagaatttgttaattcagtgtcccaagtgagtttatagaataaccaccacgaataatgagaagcaacggcacaaactttgtgtacacaggcattttttgagagagagagagagctataatatttatcaaattctcaagggggtaactgaaaaatgttcaaccattacttcagaacttctattatgagacaaatagtgctggtcctcttgagaaaccaagggagtgggctcagctcagtgactgtctggatcagcccagaaacaatgtaggctgccatcttgatctgtgcttttccccagggacatgagcaagggcacttctaggccaagcaaaatcaatcgtgtttcatagatttggatttagagggcgctctaaaccagctcagaggaatggtatgttttagaatcctagggaaattgagtwctccaatcatcacttcagtcagctaggaaagatacacttttggcagggtgcggtggctcacgcctgtaatcccagcactttgggaggtcgatcacaaggtccggagttcaagaccagcctggccaatatggtgaaaccctgtctctactaaaaaatacaaaaattagccaggtgtagtggcatgtgcttgtagtcccagctacttgggaggctgaggcaggagagtcgctggaaccagggaggcggagttgcagtgagccgagattgtgccacactccagcctgggcaacagagcgagactctgtctcaaaaaaataaataaataaaaaagatatccttttaataaagaaaaaaaaacaacacataaaacttaagagtgtaataatagctgctgttcattgaatgcttaccaggaactagtatgatcataaggaactcttacaatcaccctgagagggagggcatggcaagccctaattaatggatgaagaaactaaggc

SEQ ID NO: 33 - DNA, 1001 bp, Homo sapiens; identical to SEQ ID NO: 9

SEQ ID NO: 34 - DNA, 1001 bp, Homo sapiens; identical to SEQ ID NO: 24

SEQ ID NO: 35 - DNA, 1001 bp, Homo sapiens
cctctagaatccttattgctgttcccacattctgatcataaatttggataaattcactgctactcaggcttcaagctgatataatgaatagagggaaaataggcacccaaagtcaataagaagcacaggtgatgatgcccctgtgatttgtgggattgtaaaaatacattgtcttctgttttccctttttgcccaaatccaaatttagaagagaacattctgggaatgtatacgtaagaactgcaacatgaaggaacaaacaataaccatgataaagcaagcaggcaaacaaaaaacagccctgtgactataaccacaaagctgggcagcatataattctaatttaatagtagctggaaaaggcttctctctactctatagtcatggcccccatgctcaacatggaactcctatattttagcttttaagtcatcataaaatattaaggggcccatattctttgactccctaggtttccagaattacttggattttctgagsacattttcatttcttagtgacacatgcaatgtcaatagattttggaaaagtatttctcatgttccctatttacctacaaaattcttctatgcatcttttctccaagaaagatttaaggatgaagaaattactatgatacattaagaaaggccaaaggaagtatactctaatatataccacattatgtacttaggctaaaaaacgtttcattcctttgtgatattttcttccttctgtgtaagcaatttgtcatattttctaaaaccatgtttttaagatttttcttggctactctttaaacttatttacttctgaagtatgaaaaacacagttctcttagtttgagtgcaatgtgcacatacattagggaaagaacagcctattcaataaataattctgggaaaactgaatatcaacaagcagaaaaatgaagccagacccctctcaccatatgcaaaaatcaactcaaaatgaattaaagacttaaagcaagacccaaa

SEQ ID NO: 36 - DNA, 1001 bp, Homo sapiens
  modified_base (501)..(501): a, c, t, g, unknown or other
ttctttcttatttatttgtacattatctgtttgtatccttgaattttctctgggatgttataaaagaaaaatattacaagcataatttctgacacaatgttttataactgttttcaaaagcaatctatttctctcttaatttctatagaacccattttagtcattcctatgatgaatgaaaaaaaactcacaattagttgtcagtttcagaaaggagtctcagaagcatcttagaaccacctaggcggtcttataggcgtcacagaaaaatattccaccttacttattcttatcttcttcaaactgactccaaatataataagcaggcttaagttatataaggttccttaaaagttgttctcaaaaacaattaaatgcagactgtcctcagtaaaacttgcattggcccagtccattttaccaagtttgctccttcttacatgtacgactgcccctgtgacaagtttaagcctacgttaattaatcatctttccataacantgagacatattcatccaaccctgagagggataaggggtaacaggcaagatatattcaaattgtgacatttaaggtcaacttgactttaaaactcatatactgctcagttttcatatacgtggctgaaaacaagtcatcacagagaactggtcacactgttagaggaccaaaatagtaaaatatgaacaattcttccatatttaatgatattaaatataacaggtcctatgtctatgcaattgaagtcaacatgtcactaattagggcttcctttgttatcaaacttgctgagaagatagaacagtgaggaaaaaatagcaggaattgagctgtacagaattaaagacattcttatgaaccttaagacttaaggtcagtcacactcatatgacatttggactattagacaactcttctgacctcaaattttgctcttaccagttggtgataatcctttggtaagagagcatgttaaaagtaaccaaatcagataaggacta

SEQ ID NO: 37 - DNA, 1001 bp, Homo sapiens; identical to SEQ ID NO: 13

SEQ ID NO: 38 - DNA, 1001 bp, Homo sapiens; identical to SEQ ID NO: 28
  modified_base (501)..(501): a, c, t, g, unknown or other

SEQ ID NO: 39 - DNA, 1001 bp, Homo sapiens
aaagctcagtcccagatcctcggccatgctcctgctgctcctggaggcacctctgactcctgggcagagagagcccccattaaatagaagaccagctctcacagtgggtgacttaatcactcagtctcctccttcccttttcctctcccctcccctcttcaagagcacactgtggccctaccctgctagagaatgcaccgcctacaacagaaaccaagtttggtttgaggaaaaaaaaaaaaaaaaaaaaaagaagaagaaggagaagaagaaagctttcccaagcatatttatatacagtatgctcatgtgctccttccttcgtttacagaaggaagttaggaaagtccctgaaggaggagagaaagaattcatcaagtcagtgggtggggcaaattaaaatatacctgttccctgcactggaggcttaccagctgtgccagtctggggagtgtgcttctggaagtgaaagtgagggatgagaggtgtgtggtttgcagrttgggaaacggaaatcacatttgcatcagctctttgcaaagtgctgcctagccctctgtcattttgaacctcatagaaattcattctcagtgtacagatgggaatagcaaagttctaaaaggtgaaggcacttgtcctaggtcatccaaggatgaagacagaggagctaggaagatgacctagttctaaatcacggcttggagttgtaacctctagcacatgactgcccatgaaaggaaagtatttccagtctgcattgaccattgtttaatcagagtatgaggccacagatcgaggtgactgtctgtgagggtagaacattaaccactactccctgattagtctaaagttaattgatcatgtgatgtgctttgcctgcagttgggtgtgggggccacaacatgtaataaaagattatatttattaagtgcttactttgtgccaatcactgctctaagttaaatacatcaataaaattattcaatcctgagataaatttt

SEQ ID NO: 40 - DNA, 954 bp, Homo sapiens
ctcagcactttgggaggcttaggcaggagcatcgcttgtgtccaggagcttgaatctagcctgggcaacacagtgaggccccatcgctacaaataatcaaaattagccaggcgaggtgcatgtgcctgtagtcccagatactcaggaggctgaggcaggagaattgctgtcctcctgcaccagaagcctccagttgctttgtgtctcagtggctcaccctattctggacactttgcataaacagagtcccacaggcttgtcctcaggtgtctggctctgtcactcgcataatggccttgaggttctccacgccgcagcgtgcgtcaggacagcggcctccttcctttttcaggctaattctcccctgcacgcatggatcacgtttggtgcatccgtccacccacgaggaacactcgggtggttcctaccttctggctgccatgaacattcacggacaggcatttgtttgagtccctgttctgaatcctctggcctatatcsctaggagagaactgctgggtcctgcagtgcttccacgctgagcttttcgaggaactgccacaacgttccccatggcagctgcgcccttctgcttttccgccacgatgcacaaagctaacaatgcctctggtctctgtgtgcagtgcccttcagagagccgtcctcaccggcaaacaagcagcggcatccccctgggagcttgttctgaatgcccggcgcgtctccaaacacacttggagaaaccacctggacggtgctcaaccttgaacctctgaagcttttagacactgtcccgatgccaggtgccagcccagagcttcaggtgcaatgggtctgggcatgggggctttcataggctgcccagatgaccccactgtgtggccggggttgagacgacagccctgggagaagcttctgctgccacctgggctgctctgcggggagtatgctggc

SEQ ID NO: 41 - DNA, 1001 bp, Homo sapiens
agacacacttcgtgacctcactaggatttgctttacaagataagattttcctggcaagcattgaagttagtgcccagattcaaaacagcaaacttaaaactattatcttcatgcttgctataatcaggtgtaccgcccaacttcccatccctacctccccttccctagtaatccagaggtactcaaggtcactactggctacttaaggtttacatccactcccaaggaaacaccagcaaccaaaagaatacttcccagatggaaaacccgtcatttgaccttggaatgctctgcctcccataatgaccaaaataaggtccggccagaggggcttacgttttttggtaaggaacaacacattgttttagagagataatctgacataactctgctaagctctgagtgtctatgcatggtaccacagcaaacaccctatgtcccaaatggaaactagcagggtgaaaaaattgttcatctaagatgacattaatctctgtatghctccttggtacagttcttttccacaacatgcagcttaagattcaacaattttttcattgtgttttgtgtttcctgaagcattcctccagctacctgaagctctcactgattaaaatagacctcctttactaaaaggggtaaactgaggcacagaagaacaaagcaatgtgccttatagttcagaataggtaaacaaaaattggacatctattattttcaaatctctttagattaaaagaaaaaaaaatgtatttctcaaagtccaaagtcaaccttctccaaagggaaactgcatgtctgtctagtaacctataggatcattcacacttttttttccttgagaaggaactaacttgccagcctaccaacaattttgccagtgccttggcatcaggcatatctgcacaacctttccagagcctatatcatagtgatctgttcaagctgctcaaagctcagtaatcatactaatctgtgcatagtgaccagtgctacctgct

SEQ ID NO: 42 - DNA, 1001 bp, Homo sapiens
  modified_base (501)..(501): a, c, t, g, unknown or other
gctcccccaaagatatttacatcctaccctgtgaatatgctaccttacatggaaaaaggggctttaaaaatatgattgagttgagaatcttgagatggaaagttatccagtattatctgagtgggcccaatgtcctcacaagggtccttataaagtgagaaataagaggatcaaagtaagtagtaggtgatgtgacagcagaagcaagaggttggagtgatttaaggaagtgggagatcaggaagtgttaagcacaaagttaacttatacctttaaaaaaaaaggaaaattaaagacaacaagcagatatatacattatataaataaacacaagaacttgttaaacttgtgaaacacaggactacccaagacaaatgtttccctttccatttctactctaggctatatgaggaatctatttttctctttttcttagaactcttactctgcaggatcaaaatgtcaagcagtgaccacataagtgggaagtagatcaagacntgcttataattacattcttgtggttggtataaaattctgtaccacagccattccttagaagccagctcatgggatcaaacagacaagcaagctcacttctcaagcccacgatgttacgtattagtccatattggtgagttcctttgtgcccaaacttagctgccgcacactacagtgataggaaactgccaacagttttttgtcaaacccactacagtggatcccacaatgggctgagacctcgtctagagtcatcaggttttccaggatgtgcagatggcctggaaacttggccaagaggtagggatcagcactctttagtaagctgtatatccaccaaatgctgtgacacaaggaatgggcctcaaaatgtttcaggccagcacagctttgtctttgcaagtcatttttcagtggcagttaaatattgtggcaaagccaaggtacagactcacgtgcattaaaatatgcttatgagtaataataccataagtatttcc

SEQ ID NO: 43 - DNA, 1001 bp, Homo sapiens
ggggtcaggttgctggtcccagccttgcaccctgagctaggacaccagttcccctgaccctgttcttccctcctggctgcaggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggtgagccagaggcctgagggggcagcacactgcaggccaggcccacttgtgccctcactcctgcccctgcacgtgcatctagcctgaggcatgccagctggctctgggaaggggccacagtggatttgaggggtcaggggtccctccactagatccccaccaagtctgccctctcaggggtggctgagaatttggatctgagccagggcacagcctcccctggrgagctctgggaaagtgggcagcaatctcctaactgcccgaggggaaggtggctggctcctctgacacggggaaaccgaggcctgatggtaactctcctaactgcctgagaggaaggtggctgcctcctctgacatggggaaaccgaggcccaatgttaaccactgttgagaagtcacagggggaagtgacccccttaacatcaagtcaggtccggtccatctgcaggtcccaactcgccccttccgatggcccaggagccccaagcccttgcctgggcccccttgcctcttgcagccaaggtccgagtggccgctcctgccccctaggcctttgctccagctctctgaccgaaggctcctgccccttctccagtccccatcgttgcactgccctctccagcacggctcactgcacagggatttctctctcctgcaaaccccccgagtggggcccagaaagcagggtacctggcagcccccgccagtgtgtgtgggtgaaa

SEQ ID NO: 44 - DNA, 1001 bp, Homo sapiens
cacaaaccatataagacattattgttcccattttacaggtggaaatctgaagctctgagaggtggaatgagttgcctgaatttaccagaatgtgggatttaccagaatgtttaccagaacgaatttaccagtcaggctttgaggccagatctgtctgatccaaaatcagtgctctttctgaaatgctgatgcaaaaggaagtcatcagaactctatagaccaaccctgcacatttgttaccttctccagaagtgctttcgttgctgatataccagacgtcttttgttaaaattaatctactaccatcaccgtatggggaataactctggctagcctaagaaaagcaaccttacataggtaaaaataattgcaccccttccatctgccaaaagagttctattgtcggtttcccaggcaatatatgtgctttgggaaatattgccattagacaatctgagtgtggttgcagtaaagtattctagaatgactggaatacccagmaaactgggtaagaatcatgtgttctgctgtcagcagaccttgtctgggcctggcaaactctgcctctggggttagcaaaactcccttacgctcccctctttcaaacaagagtgattatcagttgtcaaagttgttacttctgcagagaaggaaaagtggttctggacactgtccacagattgtttcctcctctggggcaagaggattgggagaggggtatgcacatgcttttctcaatttgtggtttttgcttgggtttgtggtttaaatccctaattttggcaatcatctctgccacagaccatccaatccatgcaggtgggttcattccatactctgtgaaatatattttgatgttagaggggtgggaatgtctgatttattgtttcatcctcgtctctggggaggggaagcaaagctagtagtagtttttttttcaagggcaatctcaggccattctagaatgcttcattgcagccacactctgattgcctaatggc

SEQ ID NO: 45 - DNA, 1001 bp, Homo sapiens
gtgggaggatcacttgaggccaggagcttaaggctagcctgggcaacatagcgagaccccatctctacaaaaaataaaaaattagctgggcatggtggtatgtgcctgtggtcctagctacttgggaggctgaggtaggggcattgagcctaggagttcaaggctgcagtgagctataatcacaccactgcactccagcctgggtaacagagtgagaccctgtctcaaaaaaaagaaagaaaaagaaaaagaaaaggggtatttattgaacacctactatgtttcaggcactgtgctagatcctaagtgaatatcagcacatgaacaagacaaaggcgaaaagttaccaaacaagtctaagttgatttcggtatatgcatcttcctgacttctggtcccgtgctttgaccacaacccttcaccactagaccagacttccccaaataaacaactacttctgcatgctggggatgggctgtgtgcggcagcatttacgtaggyggtacagacagcagcctttcacttaatgttgcaataacaccaggctaaacaatgtgcactgacttcaaaagtgtggggtcaggtctccttcaagtgccacagggagagtgcaaagtaggaaaagtctatcggatgaggaaacactgtagagggaaagtgaattttttttcaatttgggttaaaattcagatgtggaattctaccctccttttcacttttggatccccagataggaggaactcagcacatagataatcatgaactacacacattttggttttatatgctcagacttgtccagagcatgaaatccctgccctgttggaaggcagcgccgtgctcacggaggcacacaagcacctgtctcaaagtcaccctgacctgcagatctgcaaatggcaaaaataatttcacatgtttgttctgatttgtcttcatttttaggctaccttgtgtgagctccactttttagaatgtgattttgcagtcctgaaatggat

SEQ ID NO: 46 - DNA, 1001 bp, Homo sapiens
gacaggagctgggcagcagcaggaagacggggggcacccctcctggcgtcctggccgccgggacacccctctccgggagaggacactcggtgcccctccgtgaagccggtaacctcggctgcgccacctcccccacccgcgcgcccgcgccgggaaagccagcgtggccccagtctccgaatttctcggaatgaacaacagcaaattgaatccagggctccggcgggggccgcctttgctggccactggttctgcagcctggcgagactgcgcttagtccccgcctggagtgcctcccgaaggcctggctggaagctagactcagtccctttgtagtagcagcggtggagcagggaccagcgtcttggacgggtgacccagactcaattccgactttggccgagggcatgtttgacactgggtgtgaaatctagacagttcccgcggtcatagagatggggcagcagcattcaggcagggctcagaactgtccgggtcccrtcagtgttggggcggaagaggaagagtgtcaactgagccaggcatttatttattttattgttgtttgagacagggtgtcgctctgtcgcccaggctggagtgcagtgggcagcatctcagctactgcagcctccgcctcccgtgctcaagcgatcctcccacgtcagcctcccaagaaggtggtattattggccacgcctggccaatttttgtattttttgtagagaggaggtctcactgtgttgcccaggctgttcttgtactcctgagctccagcaatccacccgccttggcctctgaaagcgctgggattacaggcttgaggcaccgtgcccagctgagccaggcttttaaaaccggttctgtccctacccagagagcttcttacctggcggcctccttaacctctgacaccagctgaccacgcttatgagccaaacataaaaaccaaaagaaacccaggcttggtggctcacgcctgtaatcccagcactttggga

SEQ ID NO: 47 - DNA, 1001 bp, Homo sapiens
tatccaccagccttggcctcccaaagtgctaggattacaggcatgagccaccacgcatggcctgtcttttcttcttggtcattttcgctaaaggtttgtcaattttgttgatcttttttgttgctgatctctattgttttcccattctgtttcatttatttccattttaacctttgtttccttttttctgctggtttgggtttaatttgctctttttttcccctaatttttcaaggtatacagttaagttattgatttgagatctcttttttcttttctttttttttttttttttttttttttggttgctgttgagatggagtctccctctgtcacccagactggagtgcagtggcatgatctcagctcactgcagcctccgccgcccaggcgattctcctgcctcagcctcctgagtagacgtttcccggccaaggtgtttctttttgaatgtaagcatttacagctacagatttccctctaaacactgctttcactgcdttccataagattgttttttgttgttgttttgttgtttgagacacagtctcactctgttgccgtttggagagcagcgatgcgatcatagctctgtagccttgagctcctggactcaatcagtcctcctgcctcagcctcccaagtagctgggactacaggtgtacaccactgcacctaactaatttcttttataagtttttgcagaggccaggcacagtggctcacacctgtaatcccagcactttgggaggccaaggtgggtggatcacctaaggtcaggagttcgagaccagcctggccgacagggagaaaccccatctctactaaaaatacaaaaattagctgggcgtggtggcaggtgcctgtaatcccagctactcaggaggctgaggcaggagaatcgcttgaacctgggaggcagaggttgcagtgagccaggatcacaccattgcactccagcctgggtaacaaaagcaaaactccatctcaagaaaagaaaa

SEQ ID NO: 48 - DNA, 1001 bp, Homo sapiens
  modified_base (501)..(501): a, c, t, g, unknown or other
catctggctacctcggcctcccaaagtgctgggattacaggcgtgagccaccaagcccagcctaacgttacatttctttctttctttttctttccttttttttttttttgagacagactctcactctgctgcccaggctggagtgcagtggcatgatcttgtctcactacaacctctgtctcccaggttcaagcaattctcgtgcctcagcctccccagtagctaggattacaggcacccaccaccacccccagctaactttttatattattagtagagacagggtttcaccatgttggctgggctggtcttgaactcctgacctgaagtgatccaccctcctcaggcttccaaagtgctgggattacaggcatgagccatggtgcccggctatatttctaagtttattttgcttcatataccaggaaccgtagtttgtttcacatgtggtcttgaaaatagtttgttctgttctgattataagtaacatgtgtttattgnttttttttaaaaaagggtaaatatccaggtgcagtggcatgtgcttgtagtcccagctactcaggaggctgaggccggaggaagcttttgagcccaggcatttgagactgtagtgagctgtgattgttccactgcattctaacctgggtgatagagcaagaccctgtctcaaaaataaaatacaattaaattaaatttaaaaattaaaaaattgataaatatagaaaaaatgtgaaaaccaaaggggaacgcctcccactaccagagatcatttctattttcattctggagaatttccttctagtttttttttaaaacgcataaatatgggaaatacacaattatgggaaatatacaacttcccataatgagttaacacaccatttacgattttgtgtcctgctagtctgtcattatgtcattagcgtttatcccttgcataaaatgcttctcagattactaaatggcaacatactataatattgaactttgtggatatc

SEQ ID NO: 49 - skipped

SEQ ID NO: 50 - protein, 251 aa, Homo sapiens
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 51 - protein, 192 aa, Homo sapiens
MQLTKGRLHFSHPLSHTKHISPFVTDAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 52 - protein, 174 aa, Homo sapiens
MRRFLSKVYSFPMRKLILFLVFPVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 53 - protein, 483 aa, Homo sapiens
MFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSCARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 54 - protein, 595 aa, Homo sapiens
MRVLLAALGLLFLGALRAFPQDRPFEDTCHGNPSHYYDKAVRRCCYRCPMGLFPTQQCPQRPTDCRKQCEPDYYLDEADRCTACVTCSRDDLVEKTPCAWNSSRVCECRPGMFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSCARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 55 - protein, 116 aa, Homo sapiens
QVQLVQSGAEVKKPGASVKVSCKVSGYTFTDYYITWVRQAPGQALEWMGWIYPGSGNTKYSQKFQGRFVFSVDTSASTAYLQISSLKAEDTAVYYCANYGNYWFAYWGQGTLVTVS

SEQ ID NO: 56 - protein, 111 aa, Homo sapiens
EIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIK

SEQ ID NO: 57 - DNA, 1001 bp, Homo sapiens
  modified_base (501)..(501): a, c, t, g, unknown or other
tccttattcctggctcttccagaggctggtggctcttagggctcagcagggctgctgcctgggacagggagaccaggggacccaggaagccctggctcagaggaactgcattctgcccgcaacaaagacggagtcaaacaagaactccggagtttgcagaagtgtttccctttaaggaaacgcttctatcctgtgcagcaacctaggtttagggtccaactgtctccaaaggaccacttgagaagcaagaaggagcctggtgaggctgctcccagtgccctgcggccagcagtccacacagccggagagcccatctctgagctgggcgccccatggcaaagcaccccctgaacttaccagctcgaaggctgctgaagagcaggaagagcagtccaggactggaaaaaacaaccagaaaggcaggtgaggcggggccaccagggagttacctgtatcttccaaacaggaacaggctggttcccatgagcaggaggtagttangcccatcacagaaatgtgaaggcagagccaggagcctgcctgcctctgttctccatgggaattcggggtccggggccaggaccaccaccctcctgcccagcacagcaagtccgaggggctggcagcctctcaccactctctagctctcgcggtaacaaatccccagaaacacagtgatgctggcgtgaggatgaaggggagcgagggacgccagtgaggctggtctagccttcctggggacagatgccaagaagttgtaggaaatcagaaaaaaaaaaaaaaaaaaaagctttcagggcacatatagtaggagtgtcacttaaaatgctggggagacggagaacatcaggcgtgcccgtgacagggtcaggtgagtgacgggacagccctgtgcggaacgcggatcattttgaaaccaaacctgagctcctcctgtttcagatcctgctgcagctggtgcccctgcctcgggcagcaaattcccctcgtgactccaatgc

SEQ ID NO: 58 - DNA, 1001 bp, Homo sapiens
  modified_base (501)..(501): a, c, t, g, unknown or other
tctggctgccgacagtcaggttctgctgcagaagcacgttctctatgcagcagccaatgttcacgctgggggtccgtgcgatcctcagcacgctgaccacgtcatacaagccccgcatgttcaagaagacggtgtcattctgcagagcctggtccagcaggctgttgtccgtcttattgatccagtacacgttgggcctggggtagccgtttatggatgtacacgtgaaggtgagctcatcctgggaggggctgtggggggcgctgacgacgggcacgctgaagtttgctgcaggggagggaaacagattgtgagagatgccagaccctgctggtcaagaaacagagggtacacggtgccaaggctgggtcagaggggaggcggcccattgtgccccgacatgggtgacaggccaggaccagggctgtggtccgagcagcaggctccgccctgtcctgcccaagagtcatcccccaagccagtcccagtagccagggaccnctgagcctgtcgggcagtgactggcacccacagaccccccactccacagccgtcggctgtgccgggaccccctcatttggatctggtcattctcactgctgacacaggggctcacagtccatctgaaatggacacagctgttctccccaatgaactgcccagagctccttggttgcctcttatttttctcttaaattttgttctcatttagtgctttatagagttcccttcaaatttcacttttaaaactctagtttggatgtggtggctcacgcctgtaatcacagcactttgggagggtgaggcaggaggatcgcttgtgtccaggagtttgagaccagcctgggcaacatagtgagaccccatttctacaaataatcaaaattagccaggcgaggtggcatgtgcctgtagtcccagatactcaggaggctgaagcaggagaattgcttgagctcaggaggtcaaggctgcagcgtgatcacgctactgcactccag

SEQ ID NO: 59 - DNA, 1001 bp, Homo sapiens
  modified_base (501)..(501): a, c, t, g, unknown or other
agaatttctcagcaattacattatattgctgctcacttgcagtaggaaagctgtcacaaatgtggcagacacagggtagctttactgtttgtgcagctacgtaaatgcctgtgggaaaatctttttttttgagatggagtcttgctccgtcacccaggctggggtgcaatggcgtgatctcagctcactgcaacccccgactctggggttcacgccattctcctgcctcaccctcccaagtagctgggattacaggtgcccgccaccatgcccagctaattttttgtatttttagtagagatcgggcttcactatgttggccagcctggtctcgaactcctgacctcaggtgatccacccgccttggcctcccaaagtcctgggattacaggagtgagccactgcacctggcacctgcaggaaaatctgtgtgtgtcccctgcccccaaagccctctgggctggaaggcttggcaaggtttcaggtttgtgctgcggtgcntcgtccttattcctggctcttccagaggctggtggctcttagggctcagcagggctgctgcctgggacagggagaccaggggacccaggaagccctggctcagaggaactgcattctgcccgcaacaaagacggagtcaaacaagaactccggagtttgcagaagtgtttccctttaaggaaacgcttctatcctgtgcagcaacctaggtttagggtccaactgtctccaaaggaccacttgagaagcaagaaggagcctggtgaggctgctcccagtgccctgcggccagcagtccacacagccggagagcccatctctgagctgggcgccccatggcaaagcaccccctgaacttaccagctcgaaggctgctgaagagcaggaagagcagtccaggactggaaaaaacaaccagaaaggcaggtgaggcggggccaccagggagttacctgtatcttccaaacaggaacaggctggttcccatgagcaggaggtag

SEQ ID NO: 60 - DNA, 1001 bp, Homo sapiens; identical to SEQ ID NO: 1

SEQ ID NO: 61 - DNA, 1001 bp, Homo sapiens; identical to SEQ ID NO: 2

SEQ ID NO: 62 - DNA, 1001 bp, Homo sapiens
gaggtgcattcctcgagagaagattgacagttgcttttgcaggtactggatatattagcaatccagaatatctttttttgtttttgttttcttgttgttgttgttttaaagacagggtcttgctctgtcatccaggctggaatgcagtggcacaatcatagctcactgcaaccatggattcctgagctcaagcaatcctcctgcctcagcctcctgagtagctgggactagagctgcacaccaccacacctagctaatttttaaaacttttttatagagatggggttgccccggctgatcttgaactcctgggctcaagtgtttcccctgcctcagcctcccaaagtgctgggattacaggcatgaaccaccacatccagtacaggatgtctttaaattatgttatcagtttggtgtttccagaattcttggagagtagaaattctgtccctaaacttgtgtgatggtaaaatacaaattcttaaacatgtttttctcccrtttactcagaggcaaaatcaaggtagacaagtttccttactaactcgttaagaaaggcaggatttttttttttttttagtattacccagtgtgtgactttcagggtctaagccttatgtaaaataaaaaggtctacagtcagacttcccaccttcattaatacctgagaaattaatgaaatagagaatacaaataaagaaaaatctatcaagtgtgggcactagattttgtctccttttctcctgaactaaaccacgtaaatggaatctccaggtccccagagactggcagatattccttaagcaaaaccgtttcaatgtccttgcttacctttctgaattcatatgttccattatttgtggtctttaaggatttctcttttactttttgccaggccagcaatatatttaataatctgttgtttaaaaaatatttacacaattataggtttttttaaatcaaaagtctcattatgattcctaagtctgccatattgctaa

SEQ ID NO: 63 - DNA, 1001 bp, Homo sapiens; identical to SEQ ID NO: 4

SEQ ID NO: 64 - DNA, 1001 bp, Homo sapiens; identical to SEQ ID NO: 5

SEQ ID NO: 65 - DNA, 1001 bp, Homo sapiens; identical to SEQ ID NO: 6

SEQ ID NO: 66 - DNA, 1001 bp, Homo sapiens; identical to SEQ ID NO: 7

SEQ ID NO: 67 - DNA, 1001 bp, Homo sapiens
caaagaaggttttatcttcttttgtgtaatccaccaaagagatgtcactgacgttcaccattagcttgtccccttcttgcaaggagaacatggctccgaggtagatgggctggaaccagttgctacctacttcgcatacagacttggtccccatgaggagctgggttggctcagggtagctgtctgttaccttggtgatgaccacagtgatggagtctggcttgtttggtcggcctgcttgtctgatttcactgcactcagaggtcatcccacggaatgtgacctgggagtaaatgaagtagtctcccgactctgggatcagcaggaatttgttggtatagttcattcggttcttggtgaaggccaggcctagttcatgttcccagtgcagagctgggaactgatttttaaagtgctgtgtgggagtttgtctcacaactggaaagacaagaaagaggattaattttctcattgggaaactgtagactttgcttaaaaagwgtctcatatcattttcaaaatagactaaagtgatcgaatatacctaacagctaaaaactgctttggggaggaatgaatgaagaatatgtgactggacatacacatttgttcaaagagaataacatcttggactagtgacctggggcaaattactttgcctttctgagactgagtggtctgacctgaaaatttttaattttacctgagacctatgatcctggagaacaatgaaggttaaggaatccccctattcttctgtgtttaggaaaatggcttgctgcaagaattatcctttcccaaatgactcagataaaactcatcgatgcctctcttgtttacgtatgacaaggccaggcaccagacccttcaaattcccattctttgccccataagtgattggctgaactgttttatccccattcatcaattggaacaaaacacttgtcttacaggcatgaggtaagtgatagaaacttggcatctccctggtcctaatcctc

SEQ ID NO: 68 - DNA, 1001 bp, Homo sapiens; identical to SEQ ID NO: 9

SEQ ID NO: 69 - DNA, 1001 bp, Homo sapiens; identical to SEQ ID NO: 10

SEQ ID NO: 70 - DNA, 1001 bp, Homo sapiens; identical to SEQ ID NO: 11

SEQ ID NO: 71 - DNA, 1001 bp, Homo sapiens
ttctttcttatttatttgtacattatctgtttgtatccttgaattttctctgggatgttataaaagaaaaatattacaagcataatttctgacacaatgttttataactgttttcaaaagcaatctatttctctcttaatttctatagaacccattttagtcattcctatgatgaatgaaaaaaaactcacaattagttgtcagtttcagaaaggagtctcagaagcatcttagaaccacctaggcggtcttataggcgtcacagaaaaatattccaccttacttattcttatcttcttcaaactgactccaaatataataagcaggcttaagttatataaggttccttaaaagttgttctcaaaaacaattaaatgcagactgtcctcagtaaaacttgcattggcccagtccattttaccaagtttgctccttcttacatgtacgactgcccctgtgacaagtttaagcctacgttaattaatcatctttccataacaytgagacatattcatccaaccctgagagggataaggggtaacaggcaagatatattcaaattgtgacatttaaggtcaacttgactttaaaactcatatactgctcagttttcatatacgtggctgaaaacaagtcatcacagagaactggtcacactgttagaggaccaaaatagtaaaatatgaacaattcttccatatttaatgatattaaatataacaggtcctatgtctatgcaattgaagtcaacatgtcactaattagggcttcctttgttatcaaacttgctgagaagatagaacagtgaggaaaaaatagcaggaattgagctgtacagaattaaagacattcttatgaaccttaagacttaaggtcagtcacactcatatgacatttggactattagacaactcttctgacctcaaattttgctcttaccagttggtgataatcctttggtaagagagcatgttaaaagtaaccaaatcagataaggacta

SEQ ID NO: 72 - DNA, 1001 bp, Homo sapiens; identical to SEQ ID NO: 13

SEQ ID NO: 73 - DNA, 1001 bp, Homo sapiens
tgtaaacttattagtgcctctgcacaccatataattaagatcaaattctccaagggtttaaaatagggactgctgctattgtgctgctgacagcgctaaggaacagatatttgccttttttacatagacggctctgccccgcttttgctgaaattcccactctcacagggctgggagcccagcagggtttacctggaccaatgaggggggctcactctgctgggaaatttgcttttatagatggcaccaccaacgctgaaaacatggaagtggaggcaaacgttccagagcatctactgtcgcatcccctagaaggggactgtggtcaaggcagatcagtagacagaaggctggaagggaaatgagccccaaggaagaggctcagatccagagcctgtgtcttggtgagactccaacagaagtgcctcgaggctggtgcttcagaaggaagtgggtgtacagctgtgtaagtgatctgggtcatgaataaacaaatgaacmcaggaatgcatgcaccatgagagcctggaggggactataagacagacaacgggtgatctgggcacaggtatcaactgctgaacgcccagtgtgtgcgtggaggaggaagggggtcagaaaggcaaggaggatgtaccagtatggtagagacgagcaactgtgggcaaggggtgctcaggatgcatgggggtgtggagagaaggggagagcaagaaaggcttccaggggtgaggagccaaggaggtcctgaagacagctaggagttagcaggcagaggaaggggatgggcatcccagggagaaggaacggcaagaacaaagcagcacagccgtggagagcctgtcagtgagcggagagcccgtcagtgagcagctcgcctgggttccagggaacagggccagaatttttggcaggatagactcaaaggcctgaggtgaacctgcaaacaaaggtaaaaacactaactggttttaagcaggagagaaatatgatcagatttc

SEQ ID NO: 74 - DNA, 1001 bp, Homo sapiens; identical to SEQ ID NO: 15

SEQ ID NO: 75 - DNA, 1001 bp, Homo sapiens; identical to SEQ ID NO: 16

SEQ ID NO: 76 - DNA, 1001 bp, Homo sapiens; identical to SEQ ID NO: 5

SEQ ID NO: 77 - DNA, 1001 bp, Homo sapiens; identical to SEQ ID NO: 6

SEQ ID NO: 78 - DNA, 1001 bp, Homo sapiens; identical to SEQ ID NO: 19

SEQ ID NO: 79 - DNA, 1001 bp, Homo sapiens; identical to SEQ ID NO: 20

SEQ ID NO: 80 - DNA, 1001 bp, Homo sapiens; identical to SEQ ID NO: 21

SEQ ID NO: 81 - DNA, 1001 bp, Homo sapiens; identical to SEQ ID NO: 22

SEQ ID NO: 82 - DNA, 1001 bp, Homo sapiens; identical to SEQ ID NO: 23

SEQ ID NO: 83 - DNA, 1001 bp, Homo sapiens; identical to SEQ ID NO: 24

SEQ ID NO: 84 - DNA, 1001 bp, Homo sapiens
ttttccatcaggctcagaaagcagagtgacataaaagctgggtatgtgctaaggaggagggggagggaaagtctccaaataaatcatttaactcacagagtttaagactggaagattctcctgggccttgtaagctataaaaaaaagcagatctctgtcaagaggccttttctctaaagcagttctgactcagcctatttgcccttggaagatgctgcagcacctaagacatccacaggccatcagtcaacacgtgatctcctctctagctatgctccctctagaaatgcaggatcttttgccccatcctaaactcagaaaaggggtttcatgtgcagaacatggtggagaatcctaggtctctgactcacaaaaggatcaccttgggcctgagcttcctcatctatgaaatggggatgggaattcatgccttgctgtataattgcaaggattctatggagtaataaaggtaagcgtctggcatggtttctgtacatctcrggtgctcctggtactggctgtcacacaggtcaataaatatcatttcctcctaatctttccacatgcatagttattggaaagctgggtgggcagcaggctataatttttattttgcccaaaaaggcaggaccttattttgtttatagaaggcagaacctctttgttctgcttgaaacaaacaaacaaacaaaaaacctctccaaaggctcttttcatcctctgctaaattggacaatccagtcggtccctctggagtggactcagttgattgcctacccagcacccatttctccccaactccctacctcctttttatttctcctgctttatagaactctgatttcatacagatatattcatgttcctccctggccatgtgcctcaaggaaggtaatcccactccagctccagggggttttctgattggtctaagacttggttctcaatctcagagctattgatattttgggttggatttttttttattttttatttttatt

SEQ ID NO: 85 - DNA, 1001 bp, Homo sapiens
ctatctggtggaatttgaaatatttgtgtgatccaggcacctatctttaaaaaggatggagtacttgaccttccatccttgtcccatggcccttcttcctttgcttgttcagtcaagccaaatcccaccacgtctctatcattgtaaaacttttcagggagaaaacctcaatggaaccagggaaagcatacctaccaggtcttttacttttactttttttttttaaggttgagttccacacactgttggtggcacctaaaaaaccactgccaccagttgaaaagttaattatggattaccccttgaaataaaatacaagttttattagaagtggagggataaatcaaaacagctggagggggaatgccatgaaactgctatgacgaagcccatgatgttctacttagagtaaacattctttttattttattttttttaagtcctgggtctgctgtgtagaaagtcatcatcgctttcatgtgggacaaaagaggatttggmaagggaatttccttaaatctgtgcattgaaaatgcagcttatgggagcctaaagaaaatacgttttgctttttcttacagtgggtgcctcttaattgtgacttttataaaccccttctgtagctatcataaccatccaattatctaacttcattttcgtatgattaaaagagcctctcttgccgaacatatgacaattattagaacgtttctaaaatctttttttctagtgatatgaaactcctgtagataaaataagtcttgatttatacaatcctcaagtacatgtgaatgttatgtctataaataaatactccatagtagatgcaaaatccctttataagtaacaatacattggcatattcattgaccaaaaagccttgtgatgttaatgttaacaaaattaaacttcagccatttcattcaactagtaattcctgagttctaaggactaggcactatgctaggcagggaagctatatatgtatgtgtgtctgtgcc

SEQ ID NO: 86 - DNA, 1001 bp, Homo sapiens
accatccatggtgagcggctctaactttcaatctggccagatcattttccccttgtattaaaattgtcctggaaaaccattaggttgattttcaatcatcacagctaatacattccttgttgcaaatgccaagtattctgcacttgcttcagtttttcagatcttctctctcatattcagtacctggggtgaaatccatgcctagtaaaacagcccttttgtatccaggccaggatgcatctctgagacttgaatgcttttgctttctctcctgttttttgttttgttttgttttgttttgttttggttttgttttgttttgtttctcttctctgcctgatcaatactttcccatctgaagaagcaaaacattctctctcttctgtttcccttgctgctgattctggctcaaggggatgggggcaggagtggaggaaagagggtcagagtctatatttaaccacaaagataattcctccttgacagcagctccagagagartttgacatttgaggggactgagtagcaagagtaatttgcatttatctggctatagaaacagaagagattgggagcaacaagtgatctgtggaggtaaaaatgagtcaggggtttggaagagggaatatagggcaggtgaagaagaagaaattatttgccaacaatgatggaaggataaagaacaagactcctgaaactatttccttaaatgtcacactaaagcaactccaagaggattgtaatagctttggagtgggacaagtggcacagatgggaaggctgacatgtcccggctgcttaaatactctgaattctagatctgcatttatcaaaatttaatgtacacccgaattgccctggatcttgaataaaatgcatatattaattcagtaggttggggtgggccccaagattttgtatttttagcaagcttccaaatgaagctgatgttggtcctgggaccacactttgattagcaaagctctgctagagcgttttgg

SEQ ID NO: 87 - DNA, 1001 bp, Homo sapiens
atattctttcctgtctgctgccttgtaagacgtgactttcgctttctgccatgattgtgaggcctccgtagccatgtggaactgtgagtccattaaacttctttttgtttataaattactcagtctcatgtatgtctttatcagcagcataaaaacagactaacataacccccctttcttcctacccctgtgatttgggtggatattaaaattttgcaagccgccactctagagaagtaccactcaaaccatggtctgcagactaccagcattagcaaggcctgggagtttgtgagagatgcagattcttggtgcccatccaaacctacagaagcagaatctctggtggcaggaaccagcaatctgtgctttcaacaagctctctgagtgcttcttctgaatgttaaagtataagaacctctgctgcacagggagacctcactttcattattctcatttcacagatgagaaaaatgagtcagtaggaggaaaagtgattgmctcaagtgcttaataagtgtctaagctaggatttgaccctagggcttgtgaatctggagcccatagactcaactcctgtgctatactgcctctgtgtctttggtctgtgttctcttctttttttttttttcttaccaccctccaaaattcttatttatttattttctatcaccgtacttactggtggagtggaagtcccttggaagtgggggacgtgtctgatttgtgcatggctattttgcgatttgccattgctggaatatttagcaagcatcaatgagtcctggagggcttttaaaccatagatgatcagggcccctgcttggtctaggatggagcctgcaattttgcatttgtgacaagctcccacggatgctggtgctcacttggcatagcaaggggttatgctatttttcaaaggcaagagaagtgtgcatgtacttgagaggagaaggggtcggtcaccatttactttgtgcctcttgctacccttcgttgcc

SEQ ID NO: 88 - DNA, 1001 bp, Homo sapiens; identical to SEQ ID NO: 4

SEQ ID NO: 89 - DNA, 1001 bp, Homo sapiens; identical to SEQ ID NO: 30

SEQ ID NO: 90 - DNA, 1001 bp, Homo sapiens; identical to SEQ ID NO: 31

SEQ ID NO: 91 - DNA, 1001 bp, Homo sapiens; identical to SEQ ID NO: 32

SEQ ID NO: 92 - DNA, 1001 bp, Homo sapiens; identical to SEQ ID NO: 9

SEQ ID NO: 93 - DNA, 1001 bp, Homo sapiens; identical to SEQ ID NO: 24

SEQ ID NO: 94 - DNA, 1001 bp, Homo sapiens; identical to SEQ ID NO: 35

SEQ ID NO: 95 - DNA, 1001 bp, Homo sapiens; identical to SEQ ID NO: 71

SEQ ID NO: 96 - DNA, 1001 bp, Homo sapiens; identical to SEQ ID NO: 13

SEQ ID NO: 97 - DNA, 1001 bp, Homo sapiens; identical to SEQ ID NO: 87

SEQ ID NO: 98 - DNA, 1001 bp, Homo sapiens; identical to SEQ ID NO: 39

SEQ ID NO: 99 - DNA, 1001 bp, Homo sapiens
ctcagcactttgggaggcttaggcaggagcatcgcttgtgtccaggagcttgaatctagcctgggcaacacagtgaggccccatcgctacaaataatcaaaattagccaggcgaggtgcatgtgcctgtagtcccagatactcaggaggctgaggcaggagaattgctgtcctcctgcaccagaagcctccagttgctttgtgtctcagtggctcaccctattctggacactttgcataaacagagtcccacaggcttgtcctcaggtgtctggctctgtcactcgcataatggccttgaggttctccacgccgcagcgtgcgtcaggacagcggcctccttcctttttcaggctaattctcccctgcacgcatggatcacgtttggtgcatccgtccacccacgaggaacactcgggtggttcctaccttctggctgccatgaacattcacggacaggcatttgtttgagtccctgttctgaatcctctggcctatatcsctaggagagaactgctgggtcctgcagtgcttccacgctgagcttttcgaggaactgccacaacgttccccatggcagctgcgcccttctgcttttccgccacgatgcacaaagctaacaatgcctctggtctctgtgtgcagtgcccttcagagagccgtcctcaccggcaaacaagcagcggcatccccctgggagcttgttctgaatgcccggcgcgtctccaaacacacttggagaaaccacctggacggtgctcaaccttgaacctctgaagcttttagacactgtcccgatgccaggtgccagcccagagcttcaggtgcaatgggtctgggcatgggggctttcataggctgcccagatgaccccactgtgtggccggggttgagacgacagccctgggagaagcttctgctgccacctgggctgctctgcggggagtatgctggctggaaggcagttatcagaggctgctttgggagcagcccctcatcccg

SEQ ID NO: 100 - DNA, 1001 bp, Homo sapiens
agacacacttcgtgacctcactaggatttgctttacaagataagattttcctggcaagcattgaagttagtgcccagattcaaaacagcaaacttaaaactattatcttcatgcttgctataatcaggtgtaccgcccaacttcccatccctacctccccttccctagtaatccagaggtactcaaggtcactactggctacttaaggtttacatccactcccaaggaaacaccagcaaccaaaagaatacttcccagatggaaaacccgtcatttgaccttggaatgctctgcctcccataatgaccaaaataaggtccggccagaggggcttacgttttttggtaaggaacaacacattgttttagagagataatctgacataactctgctaagctctgagtgtctatgcatggtaccacagcaaacaccctatgtcccaaatggaaactagcagggtgaaaaaattgttcatctaagatgacattaatctctgtatgmctccttggtacagttcttttccacaacatgcagcttaagattcaacaattttttcattgtgttttgtgtttcctgaagcattcctccagctacctgaagctctcactgattaaaatagacctcctttactaaaaggggtaaactgaggcacagaagaacaaagcaatgtgccttatagttcagaataggtaaacaaaaattggacatctattattttcaaatctctttagattaaaagaaaaaaaaatgtatttctcaaagtccaaagtcaaccttctccaaagggaaactgcatgtctgtctagtaacctataggatcattcacacttttttttccttgagaaggaactaacttgccagcctaccaacaattttgccagtgccttggcatcaggcatatctgcacaacctttccagagcctatatcatagtgatctgttcaagctgctcaaagctcagtaatcatactaatctgtgcatagtgaccagtgctacctgct

SEQ ID NO: 101 - DNA, 1001 bp, Homo sapiens
tccttattcctggctcttccagaggctggtggctcttagggctcagcagggctgctgcctgggacagggagaccaggggacccaggaagccctggctcagaggaactgcattctgcccgcaacaaagacggagtcaaacaagaactccggagtttgcagaagtgtttccctttaaggaaacgcttctatcctgtgcagcaacctaggtttagggtccaactgtctccaaaggaccacttgagaagcaagaaggagcctggtgaggctgctcccagtgccctgcggccagcagtccacacagccggagagcccatctctgagctgggcgccccatggcaaagcaccccctgaacttaccagctcgaaggctgctgaagagcaggaagagcagtccaggactggaaaaaacaaccagaaaggcaggtgaggcggggccaccagggagttacctgtatcttccaaacaggaacaggctggttcccatgagcaggaggtagttargcccatcacagaaatgtgaaggcagagccaggagcctgcctgcctctgttctccatgggaattcggggtccggggccaggaccaccaccctcctgcccagcacagcaagtccgaggggctggcagcctctcaccactctctagctctcgcggtaacaaatccccagaaacacagtgatgctggcgtgaggatgaaggggagcgagggacgccagtgaggctggtctagccttcctggggacagatgccaagaagttgtaggaaatcagaaaaaaaaaaaaaaaaaaaagctttcagggcacatatagtaggagtgtcacttaaaatgctggggagacggagaacatcaggcgtgcccgtgacagggtcaggtgagtgacgggacagccctgtgcggaacgcggatcattttgaaaccaaacctgagctcctcctgtttcagatcctgctgcagctggtgcccctgcctcgggcagcaaattcccctcgtgactccaatgc

SEQ ID NO: 102 - DNA, 1001 bp, Homo sapiens
tctggctgccgacagtcaggttctgctgcagaagcacgttctctatgcagcagccaatgttcacgctgggggtccgtgcgatcctcagcacgctgaccacgtcatacaagccccgcatgttcaagaagacggtgtcattctgcagagcctggtccagcaggctgttgtccgtcttattgatccagtacacgttgggcctggggtagccgtttatggatgtacacgtgaaggtgagctcatcctgggaggggctgtggggggcgctgacgacgggcacgctgaagtttgctgcaggggagggaaacagattgtgagagatgccagaccctgctggtcaagaaacagagggtacacggtgccaaggctgggtcagaggggaggcggcccattgtgccccgacatgggtgacaggccaggaccagggctgtggtccgagcagcaggctccgccctgtcctgcccaagagtcatcccccaagccagtcccagtagccagggaccrctgagcctgtcgggcagtgactggcacccacagaccccccactccacagccgtcggctgtgccgggaccccctcatttggatctggtcattctcactgctgacacaggggctcacagtccatctgaaatggacacagctgttctccccaatgaactgcccagagctccttggttgcctcttatttttctcttaaattttgttctcatttagtgctttatagagttcccttcaaatttcacttttaaaactctagtttggatgtggtggctcacgcctgtaatcacagcactttgggagggtgaggcaggaggatcgcttgtgtccaggagtttgagaccagcctgggcaacatagtgagaccccatttctacaaataatcaaaattagccaggcgaggtggcatgtgcctgtagtcccagatactcaggaggctgaagcaggagaattgcttgagctcaggaggtcaaggctgcagcgtgatcacgctactgcactccag

SEQ ID NO: 103 - DNA, 1001 bp, Homo sapiens
agaatttctcagcaattacattatattgctgctcacttgcagtaggaaagctgtcacaaatgtggcagacacagggtagctttactgtttgtgcagctacgtaaatgcctgtgggaaaatctttttttttgagatggagtcttgctccgtcacccaggctggggtgcaatggcgtgatctcagctcactgcaacccccgactctggggttcacgccattctcctgcctcaccctcccaagtagctgggattacaggtgcccgccaccatgcccagctaattttttgtatttttagtagagatcgggcttcactatgttggccagcctggtctcgaactcctgacctcaggtgatccacccgccttggcctcccaaagtcctgggattacaggagtgagccactgcacctggcacctgcaggaaaatctgtgtgtgtcccctgcccccaaagccctctgggctggaaggcttggcaaggtttcaggtttgtgctgcggtgcytcgtccttattcctggctcttccagaggctggtggctcttagggctcagcagggctgctgcctgggacagggagaccaggggacccaggaagccctggctcagaggaactgcattctgcccgcaacaaagacggagtcaaacaagaactccggagtttgcagaagtgtttccctttaaggaaacgcttctatcctgtgcagcaacctaggtttagggtccaactgtctccaaaggaccacttgagaagcaagaaggagcctggtgaggctgctcccagtgccctgcggccagcagtccacacagccggagagcccatctctgagctgggcgccccatggcaaagcaccccctgaacttaccagctcgaaggctgctgaagagcaggaagagcagtccaggactggaaaaaacaaccagaaaggcaggtgaggcggggccaccagggagttacctgtatcttccaaacaggaacaggctggttcccatgagcaggaggtag

SEQ ID NO: 104 - DNA, 1001 bp, Homo sapiens
gctcccccaaagatatttacatcctaccctgtgaatatgctaccttacatggaaaaaggggctttaaaaatatgattgagttgagaatcttgagatggaaagttatccagtattatctgagtgggcccaatgtcctcacaagggtccttataaagtgagaaataagaggatcaaagtaagtagtaggtgatgtgacagcagaagcaagaggttggagtgatttaaggaagtgggagatcaggaagtgttaagcacaaagttaacttatacctttaaaaaaaaaggaaaattaaagacaacaagcagatatatacattatataaataaacacaagaacttgttaaacttgtgaaacacaggactacccaagacaaatgtttccctttccatttctactctaggctatatgaggaatctatttttctctttttcttagaactcttactctgcaggatcaaaatgtcaagcagtgaccacataagtgggaagtagatcaagacrtgcttataattacattcttgtggttggtataaaattctgtaccacagccattccttagaagccagctcatgggatcaaacagacaagcaagctcacttctcaagcccacgatgttacgtattagtccatattggtgagttcctttgtgcccaaacttagctgccgcacactacagtgataggaaactgccaacagttttttgtcaaacccactacagtggatcccacaatgggctgagacctcgtctagagtcatcaggttttccaggatgtgcagatggcctggaaacttggccaagaggtagggatcagcactctttagtaagctgtatatccaccaaatgctgtgacacaaggaatgggcctcaaaatgtttcaggccagcacagctttgtctttgcaagtcatttttcagtggcagttaaatattgtggcaaagccaaggtacagactcacgtgcattaaaatatgcttatgagtaataataccataagtatttcc

SEQ ID NO: 105 - DNA, 1001 bp, Homo sapiens; identical to SEQ ID NO: 43

SEQ ID NO: 106 - DNA, 1001 bp, Homo sapiens; identical to SEQ ID NO: 44

SEQ ID NO: 107 - DNA, 1001 bp, Homo sapiens; identical to SEQ ID NO: 45

SEQ ID NO: 108 - DNA, 1001 bp, Homo sapiens; identical to SEQ ID NO: 46

SEQ ID NO: 109 - protein, 8 aa, Artificial Sequence
  Description of Artificial Sequence: Synthetic peptide
GFTFSTYG

SEQ ID NO: 110 - protein, 8 aa, Artificial Sequence
  Description of Artificial Sequence: Synthetic peptide
ISGTGRTT

SEQ ID NO: 111 - protein, 14 aa, Artificial Sequence
  Description of Artificial Sequence: Synthetic peptide
TKERGDYYYGVFDY

SEQ ID NO: 112 - protein, 6 aa, Artificial Sequence
  Description of Artificial Sequence: Synthetic peptide
QTISSW

SEQ ID NO: 113 - protein, 3 aa, Artificial Sequence
  Description of Artificial Sequence: Synthetic peptide
AAS

SEQ ID NO: 114 - protein, 8 aa, Artificial Sequence
  Description of Artificial Sequence: Synthetic peptide
QQYHRSWT

SEQ ID NO: 115 - protein, 121 aa, Artificial Sequence
  Description of Artificial Sequence: Synthetic polypeptide
EVQLLESGGGLVQPGKSLRLSCAVSGFTFSTYGMNWVRQAPGKGLEWVSSISGTGRTTYHADSVQGRFTVSRDNSKNILYLQMNSLRADDTAVYFCTKERGDYYYGVFDYWGQGTLVTVSS

SEQ ID NO: 116 - protein, 106 aa, Artificial Sequence
  Description of Artificial Sequence: Synthetic polypeptide
DIQMTQSPSTLSASVGDRVTITCRASQTISSWLAWYQQTPEKAPKLLIYAASNLQSGVPSRFSGSGSGTEFTLTISSLQPDDFATYYCQQYHRSWTFGQGTKVEIT

SEQ ID NO: 117 - protein, 8 aa, Artificial Sequence
  Description of Artificial Sequence: Synthetic peptide
GFTFSSYW

SEQ ID NO: 118 - protein, 8 aa, Artificial Sequence
  Description of Artificial Sequence: Synthetic peptide
IKEDGSEK

SEQ ID NO: 119 - protein, 15 aa, Artificial Sequence
  Description of Artificial Sequence: Synthetic peptide
AREDYDSYYKYGMDV

SEQ ID NO: 120 - protein, 12 aa, Artificial Sequence
  Description of Artificial Sequence: Synthetic peptide
QSILYSSNNKNY

SEQ ID NO: 121 - protein, 3 aa, Artificial Sequence
  Description of Artificial Sequence: Synthetic peptide
WAS

SEQ ID NO: 122 - protein, 9 aa, Artificial Sequence
  Description of Artificial Sequence: Synthetic peptide
QQYYSTPFT

SEQ ID NO: 123 - protein, 122 aa, Artificial Sequence
  Description of Artificial Sequence: Synthetic polypeptide
EVQLVESGGGLVQPGGSLRLSCAVSGFTFSSYWMSWVRQAPGKGLEWVANIKEDGSEKNYVDSVKGRFTLSSDNAKNSLYLQMNSLRAEDTAVYYCAREDYDSYYKYGMDVWGQGTAVIVSS

SEQ ID NO: 124 - protein, 113 aa, Artificial Sequence
  Description of Artificial Sequence: Synthetic polypeptide
DIVMTQSPDSLAVSLGERATINCKSSQSILYSSNNKNYLAWYQQKPGQPPKLLIYWASTRESGVPDRFSGSGSGTDFTLTISSLQAEDVSVYYCQQYYSTPFTFGPGTKVDIK

SEQ ID NO: 125 - protein, 8 aa, Artificial Sequence
  Description of Artificial Sequence: Synthetic peptide
GGSFTGFY

SEQ ID NO: 126 - protein, 7 aa, Artificial Sequence
  Description of Artificial Sequence: Synthetic peptide
INHRGNT

SEQ ID NO: 127 - protein, 13 aa, Artificial Sequence
  Description of Artificial Sequence: Synthetic peptide
ASPFYDFWSGSDY

SEQ ID NO: 128 - protein, 11 aa, Artificial Sequence
  Description of Artificial Sequence: Synthetic peptide
QSLVHSDGNTY

SEQ ID NO: 129 - protein, 3 aa, Artificial Sequence
  Description of Artificial Sequence: Synthetic peptide
KIS

SEQ ID NO: 130 - protein, 9 aa, Artificial Sequence
  Description of Artificial Sequence: Synthetic peptide
MQATQFPLT

SEQ ID NO: 131 - protein, 119 aa, Artificial Sequence
  Description of Artificial Sequence: Synthetic polypeptide
QVQLQQWGAGLLKPSETLSLTCAVYGGSFTGFYWSWIRQPPGKGLEWIGEINHRGNTNYNPSLKSRVTMSVDTSKNQFSLNMISVTAADTAMYFCASPFYDFWSGSDYWGQGTLVTVSS

SEQ ID NO: 132 - protein, 112 aa, Artificial Sequence
  Description of Artificial Sequence: Synthetic polypeptide
DIMLTQTPLTSPVTLGQPASISCKSSQSLVHSDGNTYLSWLQQRPGQPPRLLFYKISNRFSGVPDRFSGSGAGTDFTLKISRVEAEDVGVYYCMQATQFPLTFGGGTKVEIK

SEQ ID NO: 133 - protein, 10 aa, Artificial Sequence
  Description of Artificial Sequence: Synthetic peptide
  MOD_RES (3)..(3): P, S, D, Q or N
  MOD_RES (5)..(5): T or R
  MOD_RES (6)..(6): N, T, Y or H
GYXFXXYGIS

SEQ ID NO: 134 - protein, 17 aa, Artificial Sequence
  Description of Artificial Sequence: Synthetic peptide
  MOD_RES (4)..(4): T, P, S or A
  MOD_RES (8)..(8): N, G, V, K or A
  MOD_RES (9)..(9): T or K
  MOD_RES (10)..(10): H or N
  MOD_RES (13)..(13): Q or R
  MOD_RES (14)..(14): K or M
  MOD_RES (15)..(15): L or H
WISXYNGXXXYAXXXQG

SEQ ID NO: 135 - protein, 15 aa, Artificial Sequence
  Description of Artificial Sequence: Synthetic peptide
  MOD_RES (8)..(8): S or A
  MOD_RES (9)..(9): Y or P
  MOD_RES (15)..(15): V, A or G
ENYYGSGXXRGGMDX

SEQ ID NO: 136 - protein, 10 aa, Artificial Sequence
  Description of Artificial Sequence: Synthetic peptide
GYDFTYYGIS

SEQ ID NO: 137 - protein, 17 aa, Artificial Sequence
  Description of Artificial Sequence: Synthetic peptide
WISTYNGNTHYARMLQG

SEQ ID NO: 138 - protein, 15 aa, Artificial Sequence
  Description of Artificial Sequence: Synthetic peptide
ENYYGSGAYRGGMDV

SEQ ID NO: 139 - protein, 11 aa, Artificial Sequence
  Description of Artificial Sequence: Synthetic peptide
RASQSVSSYLA

SEQ ID NO: 140 - protein, 7 aa, Artificial Sequence
  Description of Artificial Sequence: Synthetic peptide
DASNRAT

SEQ ID NO: 141 - protein, 9 aa, Artificial Sequence
  Description of Artificial Sequence: Synthetic peptide
QQRSNWPWT

SEQ ID NO: 142 - protein, 124 aa, Artificial Sequence
  Description of Artificial Sequence: Synthetic polypeptide
QVQLVQSGAEVKKPGASVKVSCKASGYDFTYYGISWVRQAPGQGLEWMGWISTYNGNTHYARMLQGRVTMTTDTSTRTAYMELRSLRSDDTAVYYCARENYYGSGAYRGGMDVWGQGTTVTVSS

SEQ ID NO: 143 - protein, 107 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPWTFGQGTKVEIK

SEQ ID NO: 144 - protein, 453 aa, Artificial Sequence
  Description of Artificial Sequence: Synthetic polypeptide
QVQLVQSGAEVKKPGASVKVSCKASGYDFTYYGISWVRQAPGQGLEWMGWISTYNGNTHYARMLQGRVTMTTDTSTRTAYMELRSLRSDDTAVYYCARENYYGSGAYRGGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 145 - protein, 214 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 146 - protein, 7 aa, Artificial Sequence
  Description of Artificial Sequence: Synthetic peptide
SRSYYWG

SEQ ID NO: 147 - protein, 16 aa, Artificial Sequence
  Description of Artificial Sequence: Synthetic peptide
SIYYNGRTYYNPSLKS

SEQ ID NO: 148 - protein, 11 aa, Artificial Sequence
  Description of Artificial Sequence: Synthetic peptide
EDYGDYGAFDI

SEQ ID NO: 149 - protein, 11 aa, Artificial Sequence
  Description of Artificial Sequence: Synthetic peptide
RASQGISSALA

SEQ ID NO: 150 - protein, 7 aa, Artificial Sequence
  Description of Artificial Sequence: Synthetic peptide
DASSLES

SEQ ID NO: 151 - protein, 9 aa, Artificial Sequence
  Description of Artificial Sequence: Synthetic peptide
QQFNSYPLT

SEQ ID NO: 152 - protein, 121 aa, Artificial Sequence
  Description of Artificial Sequence: Synthetic polypeptide
QLQLQESGPGLVKPSETLSLTCTVSGGSISSRSYYWGWIRQPPGKGLEWIGSIYYNGRTYYNPSLKSRVTISVDTSKNQFSLKLSSVTAADTAVYYCAREDYGDYGAFDIWGQGTMVTVSS

SEQ ID NO: 153 - protein, 107 aa, Artificial Sequence [sequence omitted]

SEQ ID NO: 154 - protein, 7 aa, Artificial Sequence
  Description of Artificial Sequence: Synthetic peptide
TSNMGVV

SEQ ID NO: 155 - protein, 16 aa, Artificial Sequence
  Description of Artificial Sequence: Synthetic peptide
HILWDDREYSNPALKS

SEQ ID NO: 156 - protein, 14 aa, Artificial Sequence
  Description of Artificial Sequence: Synthetic peptide
MSRNYYGSSYVMDY

SEQ ID NO: 157 - protein, 10 aa, Artificial Sequence
  Description of Artificial Sequence: Synthetic peptide
SASSSVNYMH

SEQ ID NO: 158 - protein, 7 aa, Artificial Sequence
  Description of Artificial Sequence: Synthetic peptide
STSNLAS

SEQ ID NO: 159 - protein, 8 aa, Artificial Sequence
  Description of Artificial Sequence: Synthetic peptide
HQWNNYGT

SEQ ID NO: 160 - protein, 124 aa, Artificial Sequence
  Description of Artificial Sequence: Synthetic polypeptide
QVTLKESGPALVKPTQTLTLTCTFSGFSLSTSNMGVVWIRQPPGKALEWLAHILWDDREYSNPALKSRLTISKDTSKNQVVLTMTNMDPVDTATYYCARMSRNYYGSSYVMDYWGQGTLVTVSS

SEQ ID NO: 161 - protein, 106 aa, Artificial Sequence
  Description of Artificial Sequence: Synthetic polypeptide
DIQLTQSPSFLSASVGDRVTITCSASSSVNYMHWYQQKPGKAPKLLIYSTSNLASGVPSRFSGSGSGTEFTLTISSLQPEDFATYYCHQWNNYGTFGQGTKVEIKR

SEQ ID NO: 162 - protein, 5 aa, Artificial Sequence
  Description of Artificial Sequence: Synthetic peptide
LYGMN

SEQ ID NO: 163 - protein, 5 aa, Artificial Sequence
  Description of Artificial Sequence: Synthetic peptide
NYGMN

SEQ ID NO: 164 - protein, 17 aa, Artificial Sequence
  Description of Artificial Sequence: Synthetic peptide
WINTYTGEPTYADDFKG

SEQ ID NO: 165 - protein, 10 aa, Artificial Sequence
  Description of Artificial Sequence: Synthetic peptide
DTAMDYAMAY

SEQ ID NO: 166 - protein, 13 aa, Artificial Sequence
  Description of Artificial Sequence: Synthetic peptide
DYGKYGDYYAMDY

SEQ ID NO: 167 - protein, 16 aa, Artificial Sequence
  Description of Artificial Sequence: Synthetic peptide
KSSQNIVHSDGNTYLE

SEQ ID NO: 168 - protein, 16 aa, Artificial Sequence
  Description of Artificial Sequence: Synthetic peptide
RSSQSIVHSNGNTYLD

SEQ ID NO: 169 - protein, 7 aa, Artificial Sequence
  Description of Artificial Sequence: Synthetic peptide
KVSNRFS

SEQ ID NO: 170 - protein, 9 aa, Artificial Sequence
  Description of Artificial Sequence: Synthetic peptide
FQGSHVPLT

SEQ ID NO: 171 - protein, 119 aa, Artificial Sequence
  Description of Artificial Sequence: Synthetic polypeptide
QVQLVQSGSELKKPGASVKVSCKASGYTFTLYGMNWVRQAPGQGLEWMGWINTYTGEPTYADDFKGRFVFSLDTSVSTAYLQISSLKAEDTAVYYCARDTAMDYAMAYWGQGTLVTVSS

SEQ ID NO: 172 - protein, 119 aa, Artificial Sequence
  Description of Artificial Sequence: Synthetic polypeptide
QVQLVQSGSELKKPGASVKVSCKASGYTFTLYGMNWVKQAPGKGLKWMGWINTYTGEPTYADDFKGRFVFSLDTSVSTAYLQISSLKAEDTAVYFCARDTAMDYAMAYWGQGTLVTVSS

SEQ ID NO: 173 - protein, 122 aa, Artificial Sequence
  Description of Artificial Sequence: Synthetic polypeptide
QVQLVQSGSELKKPGASVKVSCKASGYTFTNYGMNWVRQAPGQGLEWMGWINTYTGEPTYADDFKGRFVFSLDTSVSTAYLQISSLKAEDTAVYYCARDYGKYGDYYAMDYWGQGTLVTVSS

SEQ ID NO: 174 - protein, 122 aa, Artificial Sequence
  Description of Artificial Sequence: Synthetic polypeptide
QVQLVQSGSELKKPGASVKVSCKASGYTFTNYGMNWVRQAPGKGLKWMGWINTYTGEPTYADDFKGRFVFSLDTSVSTAYLQISSLKAEDTAVYFCARDYGKYGDYYAMDYWGQGTLVTVSS

SEQ ID NO: 175 - protein, 113 aa, Artificial Sequence
  Description of Artificial Sequence: Synthetic polypeptide
DVVMTQSPLSLPVTLGQPASISCKSSQNIVHSDGNTYLEWFQQRPGQSPRRLIYKVSNRFSGVPDRFSGSGSGTDFTLKISRVEAEDVGVYYCFQGSHVPLTFGGGTKVEIKR

SEQ ID NO: 176 - protein, 113 aa, Artificial Sequence
  Description of Artificial Sequence: Synthetic polypeptide
DVVMTQSPLSLPVTLGQPASISCKSSQNIVHSDGNTYLEWFQQRPGQSPRRLIYKVSNRFSGVPDRFSGSGSGTDFTLKISRVEAEDVGVYYCFQGSHVPLTFGQGTKVEIKR

SEQ ID NO: 177 - protein, 113 aa, Artificial Sequence
  Description of Artificial Sequence: Synthetic polypeptide
DVVMTQTPLSLPVTPGEPASISCKSSQNIVHSDGNTYLEWYLQKPGQSPQLLIYKVSNRFSGVPDRFSGSGSGTDFTLKISRVEAEDLGVYYCFQGSHVPLTFGGGTKVEIKR

SEQ ID NO: 178 - protein, 113 aa, Artificial Sequence
  Description of Artificial Sequence: Synthetic polypeptide
DVVMTQTPLSLPVSLGDQASISCKSSQNIVHSDGNTYLEWYLQKPGQSPKVLIYKVSNRFSGVPDRFSGSGSGTDFTLKISRVEAEDLGVYYCFQGSHVPLTFGGGTKVEIKR

SEQ ID NO: 179 - protein, 113 aa, Artificial Sequence
  Description of Artificial Sequence: Synthetic polypeptide
DVVMTQSPLSLPVTLGQPASISCRSSQSIVHSNGNTYLDWFQQRPGQSPRRLIYKVSNRFSGVPDRFSGSGSGTDFTLKISRVEAEDVGVYYCFQGSHVPLTFGGGTKVEIKR

SEQ ID NO: 180 - protein, 113 aa, Artificial Sequence
  Description of Artificial Sequence: Synthetic polypeptide
DVVMTQSPLSLPVTLGQPASISCRSSQSIVHSNGNTYLDWFQQRPGQSPRRLIYKVSNRFSGVPDRFSGSGSGTDFTLKISRVEAEDVGVYYCFQGSHVPLTFGQGTKVEIKR

SEQ ID NO: 181 - protein, 113 aa, Artificial Sequence
  Description of Artificial Sequence: Synthetic polypeptide
DVVMTQTPLSLPVTPGEPASISCRSSQSIVHSNGNTYLDWYLQKPGQSPQLLIYKVSNRFSGVPDRFSGSGSGTDFTLKISRVEAEDLGVYYCFQGSHVPLTFGGGTKVEIKR

SEQ ID NO: 182 - protein, 113 aa, Artificial Sequence
  Description of Artificial Sequence: Synthetic polypeptide
DVVMTQTPLSLPVSLGDQASISCRSSQSIVHSNGNTYLDWYLQKPGQSPKVLIYKVSNRFSGVPDRFSGSGSGTDFTLKINRVEAEDLGVYFCFQGSHVPLTFGGGTKLEIKR

SEQ ID NO: 183 - protein, 10 aa, Artificial Sequence
  Description of Artificial Sequence: Synthetic peptide
GYTFTSSWMH

SEQ ID NO: 184 - protein, 8 aa, Artificial Sequence
  Description of Artificial Sequence: Synthetic peptide
IHPNSGGT

SEQ ID NO: 185 - protein, 14 aa, Artificial Sequence
  Description of Artificial Sequence: Synthetic peptide
ARGDYYGYVSWFAY

SEQ ID NO: 186 - protein, 6 aa, Artificial Sequence
  Description of Artificial Sequence: Synthetic peptide
QNINVL

SEQ ID NO: 187 - protein, 3 aa, Artificial Sequence
  Description of Artificial Sequence: Synthetic peptide
KAS

SEQ ID NO: 188 - protein, 9 aa, Artificial Sequence
  Description of Artificial Sequence: Synthetic peptide
QQGQSYPYT

SEQ ID NO: 189 - protein, 119 aa, Artificial Sequence
  Description of Artificial Sequence: Synthetic polypeptide
QVQLQQPGSVLVRPGASVKVSCKASGYTFTSSWMHWAKQRPGQGLEWIGEIHPNSGGTNYNEKFKGKATVDTSSSTAYVDLSSLTSEDSAVYYCARGDYYGYVSWFAYWGQGTLVTVSS

SEQ ID NO: 190 - protein, 121 aa, Artificial Sequence
  Description of Artificial Sequence: Synthetic polypeptide
QVQLVQSGAEVKKPGASVKVSCKASGYTFTSSWMHWARQAPGQGLEWIGEIHPNSGGTNYAQKFQGRATLTVDTSSSTAYMELSRLRSDDTAVYYCARGDYYGYVSWFAYWGQGTLVTVSS

SEQ ID NO: 191 - protein, 121 aa, Artificial Sequence
  Description of Artificial Sequence: Synthetic polypeptide
QVQLVQSGAEVKKPGASVKVSCKASGYTFTSSWMHWARQAPGQGLEWIGEIHPNSGGTNYAQKFQGRATMTVDTSISTAYMELSRLRSDDTAVYYCARGDYYGYVSWFAYWGQGTLVTVSS

SEQ ID NO: 192 - protein, 121 aa, Artificial Sequence
  Description of Artificial Sequence: Synthetic polypeptide
QVQLVQSGAEVKKPGASVKVSCKASGYTFTSSWMHWARQAPGQGLEWIGEIHPNSGGTNYAQKFQGRVTMTVDTSISTAYMELSRLRSDDTAVYYCARGDYYGYVSWFAYWGQGTLVTVSS

SEQ ID NO: 193 - protein, 121 aa, Artificial Sequence
  Description of Artificial Sequence: Synthetic polypeptide
QVQLVQSGAEVKKPGASVKVSCKASGYTFTSSWMHWARQAPGQGLEWMGEIHPNSGGTNYAQKFQGRVTMTVDTSISTAYMELSRLRSDDTAVYYCARGDYYGYVSWFAYWGQGTLVTVSS

SEQ ID NO: 194 - protein, 107 aa, Artificial Sequence
  Description of Artificial Sequence: Synthetic polypeptide
DIQMNQSPSSLSASLGDTITITCHASQNINVLLSWYQQKPGNIPKLLIYKASNLHTGVPSRFSGSGSGTGFTFTISSLQPEDIATYYCQQGQSYPYTFGGGTKLEIK

SEQ ID NO: 195 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNLPYTFGQGTKLEIK

SEQ ID NO: 196 - protein, 107 aa, Artificial Sequence
  Description of Artificial Sequence: Synthetic polypeptide
DIQMTQSPSSLSASVGDRVTITCQASQNINVLLNWYQQKPGKAPKLLIYKASNLHTGVPSRFSGSGSGTDFTFTISSLQPEDIATYYCQQGQSYPYTFGQGTKLEIK

SEQ ID NO: 197 - protein, 107 aa, Artificial Sequence
  Description of Artificial Sequence: Synthetic polypeptide
DIQMNQSPSSLSASVGDRVTITCQASQNINVLLSWYQQKPGKAPKLLIYKASNLHTGVPSRFSGSGSGTDFTFTISSLQPEDIATYYCQQGQSYPYTFGQGTKLEIK

SEQ ID NO: 198 - protein, 10 aa, Artificial Sequence
  Description of Artificial Sequence: Synthetic peptide
GYTFTSYDIN

SEQ ID NO: 199 - protein, 10 aa, Artificial Sequence
  Description of Artificial Sequence: Synthetic peptide
  MOD_RES (8)..(8): N or Y
WLNPNSGXTG

SEQ ID NO: 200 - protein, 10 aa, Artificial Sequence
  Description of Artificial Sequence: Synthetic peptide
EVPETAAFEY

SEQ ID NO: 201 - protein, 14 aa, Artificial Sequence
  Description of Artificial Sequence: Synthetic peptide
  MOD_RES (10)..(10): G or A
  MOD_RES (11)..(11): L, S or Q
  MOD_RES (14)..(14): H or L
TSSSSDIGAXXGVX

SEQ ID NO: 202 - protein, 7 aa, Artificial Sequence
  Description of Artificial Sequence: Synthetic peptide
GYYNRPS

SEQ ID NO: 203 - protein, 10 aa, Artificial Sequence
  Description of Artificial Sequence: Synthetic peptide
  MOD_RES (3)..(3): Y, W or F
QSXDGTLSAL

SEQ ID NO: 204 - protein, 119 aa, Artificial Sequence
  Description of Artificial Sequence: Synthetic polypeptide
QVQLVQSGAEVKKPGASVKVSCKASGYTFTSYDINWVRQAPGQGLEWMGWLNPNSGNTGYAQKFQGRVTMTADRSTSTAYMELSSLRSEDTAVYYCAREVPETAAFEYWGQGTLVTVSS

SEQ ID NO: 205 - protein, 111 aa, Artificial Sequence
  Description of Artificial Sequence: Synthetic polypeptide
  MOD_RES (32)..(33): Any amino acid
  MOD_RES (36)..(36): Any amino acid
  MOD_RES (93)..(93): Any amino acid
QSVLTQPPSVSGAPGQRVTISCTSSSSDIGAXXGVXWYQQLPGTAPKLLIEGYYNRPSGVPDRFSGSKSGTSASLTITGLLPEDEGDYYCQSXDGTLSALFGGGTKLTVLG

SEQ ID NO: 206 - protein, 119 aa, Artificial Sequence; identical to SEQ ID NO: 204
  Description of Artificial Sequence: Synthetic polypeptide

SEQ ID NO: 207 - protein, 111 aa, Artificial Sequence
  Description of Artificial Sequence: Synthetic polypeptide
QSVLTQPPSVSGAPGQRVTISCTSSSSDIGAGLGVHWYQQLPGTAPKLLIEGYYNRPSGVPDRFSGSKSGTSASLTITGLLPEDEGDYYCQSWDGTLSALFGGGTKLTVLG

SEQ ID NO: 208 - protein, 119 aa, Artificial Sequence
  Description of Artificial Sequence: Synthetic polypeptide
QVQLVQSGAEVKKPGASVKVSCKASGYTFTSYDINWVRQAPGQGLEWMGWLNPNSGYTGYAQKFQGRVTMTADRSTSTAYMELSSLRSEDTAVYYCAREVPETAAFEYWGQGTLVTVSS

SEQ ID NO: 209 - protein, 111 aa, Artificial Sequence
  Description of Artificial Sequence: Synthetic polypeptide
QSVLTQPPSVSGAPGQRVTISCTSSSSDIGAGLGVHWYQQLPGTAPKLLIEGYYNRPSGVPDRFSGSKSGTSASLTITGLLPEDEGDYYCQSYDGTLSALFGGGTKLTVLG

SEQ ID NO: 210 - protein, 119 aa, Artificial Sequence; identical to SEQ ID NO: 204
  Description of Artificial Sequence: Synthetic polypeptide

SEQ ID NO: 211 - protein, 111 aa, Artificial Sequence
  Description of Artificial Sequence: Synthetic polypeptide
QSVLTQPPSVSGAPGQRVTISCTSSSSDIGAALGVHWYQQLPGTAPKLLIEGYYNRPSGVPDRFSGSKSGTSASLTITGLLPEDEGDYYCQSWDGTLSALFGGGTKLTVLG

SEQ ID NO: 212 - protein, 119 aa, Artificial Sequence; identical to SEQ ID NO: 204
  Description of Artificial Sequence: Synthetic polypeptide

SEQ ID NO: 213 - protein, 111 aa, Artificial Sequence
  Description of Artificial Sequence: Synthetic polypeptide
QSVLTQPPSVSGAPGQRVTISCTSSSSDIGAGSGVHWYQQLPGTAPKLLIEGYYNRPSGVPDRFSGSKSGTSASLTITGLLPEDEGDYYCQSWDGTLSALFGGGTKLTVLG

SEQ ID NO: 214 - protein, 119 aa, Artificial Sequence; identical to SEQ ID NO: 204
  Description of Artificial Sequence: Synthetic polypeptide

SEQ ID NO: 215 - protein, 111 aa, Artificial Sequence
  Description of Artificial Sequence: Synthetic polypeptide
QSVLTQPPSVSGAPGQRVTISCTSSSSDIGAGQGVHWYQQLPGTAPKLLIEGYYNRPSGVPDRFSGSKSGTSASLTITGLLPEDEGDYYCQSWDGTLSALFGGGTKLTVLG

SEQ ID NO: 216 - protein, 119 aa, Artificial Sequence; identical to SEQ ID NO: 204
  Description of Artificial Sequence: Synthetic polypeptide

SEQ ID NO: 217 - protein, 111 aa, Artificial Sequence
  Description of Artificial Sequence: Synthetic polypeptide
QSVLTQPPSVSGAPGQRVTISCTSSSSDIGAGLGVLWYQQLPGTAPKLLIEGYYNRPSGVPDRFSGSKSGTSASLTITGLLPEDEGDYYCQSWDGTLSALFGGGTKLTVLG

SEQ ID NO: 218 - protein, 119 aa, Artificial Sequence; identical to SEQ ID NO: 208
  Description of Artificial Sequence: Synthetic polypeptide

SEQ ID NO: 219 - protein, 111 aa, Artificial Sequence; identical to SEQ ID NO: 207
  Description of Artificial Sequence: Synthetic polypeptide

SEQ ID NO: 220 - protein, 119 aa, Artificial Sequence; identical to SEQ ID NO: 208
  Description of Artificial Sequence: Synthetic polypeptide

SEQ ID NO: 221 - protein, 111 aa, Artificial Sequence; identical to SEQ ID NO: 213
  Description of Artificial Sequence: Synthetic polypeptide

SEQ ID NO: 222 - protein, 119 aa, Artificial Sequence; identical to SEQ ID NO: 208
  Description of Artificial Sequence: Synthetic polypeptide

SEQ ID NO: 223 - protein, 111 aa, Artificial Sequence; identical to SEQ ID NO: 215
  Description of Artificial Sequence: Synthetic polypeptide

SEQ ID NO: 224 - protein, 119 aa, Artificial Sequence; identical to SEQ ID NO: 208
  Description of Artificial Sequence: Synthetic polypeptide

SEQ ID NO: 225 - protein, 111 aa, Artificial Sequence; identical to SEQ ID NO: 217
  Description of Artificial Sequence: Synthetic polypeptide

SEQ ID NO: 226 - protein, 119 aa, Artificial Sequence; identical to SEQ ID NO: 208
  Description of Artificial Sequence: Synthetic polypeptide

SEQ ID NO: 227 - protein, 111 aa, Artificial Sequence
  Description of Artificial Sequence: Synthetic polypeptide
QSVLTQPPSVSGAPGQRVTISCTSSSSDIGAGLGVHWYQQLPGTAPKLLIEGYYNRPSGVPDRFSGSKSGTSASLTITGLLPEDEGDYYCQSFDGTLSALFGGGTKLTVLG

SEQ ID NO: 228 - protein, 5 aa, Artificial Sequence
  Description of Artificial Sequence: Synthetic peptide
SYFWS

SEQ ID NO: 229 - protein, 16 aa, Artificial Sequence
  Description of Artificial Sequence: Synthetic peptide
YIYYSGNTKYNPSLKS

SEQ ID NO: 230 - protein, 10 aa, Artificial Sequence
  Description of Artificial Sequence: Synthetic peptide
ETGSYYGFDY

SEQ ID NO: 231 - protein, 11 aa, Artificial Sequence
  Description of Artificial Sequence: Synthetic peptide
RASQSINNYLN

SEQ ID NO: 232 - protein, 7 aa, Artificial Sequence
  Description of Artificial Sequence: Synthetic peptide
AASSLQS

SEQ ID NO: 233 - protein, 9 aa, Artificial Sequence
  Description of Artificial Sequence: Synthetic peptide
QQSYSTPRT

SEQ ID NO: 234 - protein, 118 aa, Artificial Sequence
  Description of Artificial Sequence: Synthetic polypeptide
QVQLQESGPGLVKPSETLSLTCTVSGGSISSYFWSWIRQPPGKGLEWIGYIYYSGNTKYNPSLKSRVTISIDTSKNQFSLKLSSVTAADTAVYYCARETGSYYGFDYWGQGTLVTVSS

SEQ ID NO: 235 - protein, 107 aa, Artificial Sequence
  Description of Artificial Sequence: Synthetic polypeptide
DIQMTQSPSSLSASVGDRVTITCRASQSINNYLNWYQQRPGKAPKLLIYAASSLQSGVPSRFSGSGSGTDFTLTISSLQPGDFATYYCQQSYSTPRTFGQGTKLEIK

SEQ ID NO: 236 - protein, 5 aa, Artificial Sequence
  Description of Artificial Sequence: Synthetic peptide
GYYWN

SEQ ID NO: 237 - protein, 16 aa, Artificial Sequence
  Description of Artificial Sequence: Synthetic peptide
EINHAGNTNYNPSLKS

SEQ ID NO: 238 - protein, 12 aa, Artificial Sequence
  Description of Artificial Sequence: Synthetic peptide
GYCRSTTCYFDY

SEQ ID NO: 239 - protein, 12 aa, Artificial Sequence
  Description of Artificial Sequence: Synthetic peptide
RASQSVRSSYLA

SEQ ID NO: 240 - protein, 7 aa, Artificial Sequence
  Description of Artificial Sequence: Synthetic peptide
GASSRAT

SEQ ID NO: 241 - protein, 8 aa, Artificial Sequence
  Description of Artificial Sequence: Synthetic peptide
QQYGSSPT

SEQ ID NO: 242 - protein, 120 aa, Artificial Sequence
  Description of Artificial Sequence: Synthetic polypeptide
QVQLQQWGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSS

SEQ ID NO: 243 - protein, 107 aa, Artificial Sequence
  Description of Artificial Sequence: Synthetic polypeptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPTFGQGTRLEIK

SEQ ID NO: 244 - protein, 116 aa, Artificial Sequence
  Description of Artificial Sequence: Synthetic polypeptide
EVQLQQSGAELVKPGASVKLSCTASGFDIQDTYMHWVKQRPEQGLEWIGRIDPASGHTKYDPKFQVKATITTDTSSNTAYLQLSSLTSEDTAVYYCSRSGGLPDVWGAGTTVTVSS

SEQ ID NO: 245 - protein, 106 aa, Artificial Sequence
  Description of Artificial Sequence: Synthetic polypeptide
QIVLSQSPAILSASPGEKVTMTCRASSSVSYMYWYQQKPGSSPKPWIYATSNLASGVPDRFSGSGSGTSYSLTISRVEAEDAATYYCQQWSGNPRTFGGGTKLEIK

SEQ ID NO: 246 - protein, 10 aa, Artificial Sequence
  Description of Artificial Sequence: Synthetic peptide
GFDIQDTYMH

SEQ ID NO: 247 - protein, 17 aa, Artificial Sequence
  Description of Artificial Sequence: Synthetic peptide
RIDPASGHTKYDPKFQV

SEQ ID NO: 248 - protein, 7 aa, Artificial Sequence
  Description of Artificial Sequence: Synthetic peptide
SGGLPDV

SEQ ID NO: 249 - protein, 10 aa, Artificial Sequence
  Description of Artificial Sequence: Synthetic peptide
RASSSVSYMY

SEQ ID NO: 250 - protein, 7 aa, Artificial Sequence
  Description of Artificial Sequence: Synthetic peptide
ATSNLAS

SEQ ID NO: 251 - protein, 9 aa, Artificial Sequence
  Description of Artificial Sequence: Synthetic peptide
QQWSGNPRT

SEQ ID NO: 252 - protein, 116 aa, Artificial Sequence
  Description of Artificial Sequence: Synthetic polypeptide
QVQLVQSGAEVKKPGASVKLSCKASGFDIQDTYMHWVRQAPGQGLEWMGRIDPASGHTKYDPKFQVRVTMTTDTSTSTVYMELSSLRSEDTAVYYCSRSGGLPDVWGQGTTVTVSS

SEQ ID NO: 253 - protein, 106 aa, Artificial Sequence
  Description of Artificial Sequence: Synthetic polypeptide
EIVLTQSPGTLSLSPGERVTMSCRASSSVSYMYWYQQKPGQAPRPWIYATSNLASGVPDRFSGSGSGTDYTLTISRLEPEDFAVYYCQQWSGNPRTFGGGTKLEIK

SEQ ID NO: 254 - protein, 116 aa, Artificial Sequence
  Description of Artificial Sequence: Synthetic polypeptide
QVQLVQSGAEVKKPGASVKLSCKASGFDIQDTYMHWVRQAPGQGLEWMGRIDPASGHTKYDPKFQVRVTMTRDTSTSTVYMELSSLRSEDTAVYYCSRSGGLPDVWGQGTTVTVSS

SEQ ID NO: 255 - protein, 106 aa, Artificial Sequence
  Description of Artificial Sequence: Synthetic polypeptide
EIVLTQSPGTLSLSPGERATLSCRASSSVSYMYWYQQKPGQAPRLLIYATSNLASGIPDRFSGSGSGTDFTLTISRLEPEDFAVYYCQQWSGNPRTFGGGTKLEIK

SEQ ID NO: 256 - protein, 116 aa, Artificial Sequence
  Description of Artificial Sequence: Synthetic polypeptide
QVQLVQSGAEVKKPGASVKVSCKASGFDIQDTYMHWVRQAPGQGLEWMGRIDPASGHTKYDPKFQVRVTMTRDTSTSTVYMELSSLRSEDTAVYYCARSGGLPDVWGQGTTVTVSS

SEQ ID NO: 257 - protein, 106 aa, Artificial Sequence
  Description of Artificial Sequence: Synthetic polypeptide
EIVLTQSPGTLSLSPGERATLSCRASSSVSYMYWYQQKPGQAPRLLIYATSNLASGVPDRFSGSGSGTDYTLTISRLEPEDFAVYYCQQWSGNPRTFGGGTKLEIK

SEQ ID NO: 258 - protein, 121 aa, Artificial Sequence
  Description of Artificial Sequence: Synthetic polypeptide
EVMLVESGGGLVKPGGSLKLSCAASGFTFTNYAMSWVRQTPEKRLEWVATITSGGSYIYYLDSVKGRFTISRDNAKSTLYLQMSSLRSEDTAIYNCARRKDGNYYYAMDYWGQGTSVTVSS

SEQ ID NO: 259 - protein, 121 aa, Artificial Sequence
  Description of Artificial Sequence: Synthetic polypeptide
EVMLVESGGGLVKPGGSLKLSCAASGFTFTNYAMSWVRQTPEKRLEWVATITSGGSYIYYLDSVKGRFTISRDNAKSTLYLQMSSLRSEDTAIYYCARRKDGNYYYAMDYWGQGTSVTVSS

SEQ ID NO: 260 - protein, 121 aa, Artificial Sequence
  Description of Artificial Sequence: Synthetic polypeptide
EVQLVESGGGLVKPGGSLRLSCAASGFTFTNYAMSWVRQAPGQRLEWVSTITSGGSYIYYLDSVKGRFTISRDNAKSTLYLQMNSLRAEDTAVYNCARRKDGNYYYAMDYWGQGTTVTVSS

SEQ ID NO: 261 - protein, 121 aa, Artificial Sequence
  Description of Artificial Sequence: Synthetic polypeptide
EVQLVESGGGLVKPGGSLRLSCAASGFTFTNYAMSWVRQAPGQRLEWVSTITSGGSYIYYLDSVKGRFTISRDNAKSTLYLQMNSLRAEDTAVYYCARRKDGNYYYAMDYWGQGTTVTVSS

SEQ ID NO: 262 - protein, 121 aa, Artificial Sequence
  Description of Artificial Sequence: Synthetic polypeptide
EVQLLESGGGLVQPGRSLRLSCAASGFTFTNYAMSWVRQAPGQRLEWLATITSGGSYIYYLDSVKGRFTISRDNSKSTLYLQMGSLRAEDMAVYNCARRKDGNYYYAMDYWGQGTTVTVSS

SEQ ID NO: 263 - protein, 121 aa, Artificial Sequence
  Description of Artificial Sequence: Synthetic polypeptide
EVQLLESGGGLVQPGRSLRLSCAASGFTFTNYAMSWVRQAPGQRLEWLATITSGGSYIYYLDSVKGRFTISRDNSKSTLYLQMGSLRAEDMAVYYCARRKDGNYYYAMDYWGQGTTVTVSS

SEQ ID NO: 264 - protein, 121 aa, Artificial Sequence
  Description of Artificial Sequence: Synthetic polypeptide
QVQLVESGGGLIQPGGSLRLSCAASGFTFTNYAMSWVRQARGQRLEWVSTITSGGSYIYYLDSVKGRFTISRDNSKSTLYMELSSLRSEDTAVYNCARRKDGNYYYAMDYWGQGTTVTVSS

SEQ ID NO: 265 - protein, 121 aa, Artificial Sequence
  Description of Artificial Sequence: Synthetic polypeptide
QVQLVESGGGLIQPGGSLRLSCAASGFTFTNYAMSWVRQARGQRLEWVSTITSGGSYIYYLDSVKGRFTISRDNSKSTLYMELSSLRSEDTAVYYCARRKDGNYYYAMDYWGQGTTVTVSS

SEQ ID NO: 266 - protein, 121 aa, Artificial Sequence
  Description of Artificial Sequence: Synthetic polypeptide
QVQLVQSGSELKKPGASVKVSCKASGFTFTNYAMSWVRQAPGKRLEWVSTITSGGSYIYYLDSVKGRFTISRENAKSTLYLQMNSLRTEDTALYNCARRKDGNYYYAMDYWGQGTTVTVSS

SEQ ID NO: 267 - protein, 121 aa, Artificial Sequence
  Description of Artificial Sequence: Synthetic polypeptide
QVQLVQSGSELKKPGASVKVSCKASGFTFTNYAMSWVRQAPGKRLEWVATITSGGSYIYYLDSVKGRFTISRENAKSTLYLQMNSLRTEDTALYYCARRKDGNYYYAMDYWGQGTTVTVSS

SEQ ID NO: 268 - protein, 121 aa, Artificial Sequence
  Description of Artificial Sequence: Synthetic polypeptide
EVQLLQSGAEVKKPGASVKVSCKASGFTFTNYAMSWVRQAPGQRLEWVATITSGGSYIYYLDSVKGRFTISRDNAKSTLHLQMNSLRAEDTAVYNCARRKDGNYYYAMDYWGQGTTVTVSS

SEQ ID NO: 269 - protein, 121 aa, Artificial Sequence
  Description of Artificial Sequence: Synthetic polypeptide
EVQLLQSGAEVKKPGASVKVSCKASGFTFTNYAMSWVRQAPGQRLEWVATITSGGSYIYYLDSVKGRFTISRDNAKSTLHLQMNSLRAEDTAIYYCARRKDGNYYYAMDYWGQGTTVTVSS

SEQ ID NO: 270 - protein, 121 aa, Artificial Sequence
  Description of Artificial Sequence: Synthetic polypeptide
EVMLLQSGAEVKKPGASVKVSCKASGFTFTNYAMSWVRQAPGQRLEWVATITSGGSYIYYLDSVKGRFTISRDNAKSTLHLQMNSLRAEDTAVYYCARRKDGNYYYAMDYWGQGTTVTVSS

SEQ ID NO: 271 - protein, 111 aa, Artificial Sequence
  Description of Artificial Sequence: Synthetic polypeptide
DIVLTQSPASLAVSLGQRATISCRASESVDSYGNSFIHWYQQKAGQPPKLLIYRASNLESGIPARFSGSGSRTDFTLTINPVEADDVATYYCQQSYEDPWTFGGGTKLEIK

SEQ ID NO: 272 - protein, 111 aa, Artificial Sequence
  Description of Artificial Sequence: Synthetic polypeptide
  MOD_RES (108)..(108): Any amino acid
DIVLTQSPATLSLSPGERATLSCRASESVDSYGNSFIHWYQQKPGQPPKLLIYRASNLESGIPARFSGSGSRTDFTLTISSLEPEDFAVYYCQQSYEDPWTFGGGTKXEIK

SEQ ID NO: 273 - protein, 111 aa, Artificial Sequence
  Description of Artificial Sequence: Synthetic polypeptide
  MOD_RES (108)..(108): Any amino acid
DIVLTQSPSSLSASVGDRVTITCRASESVDSYGNSFIHWYQQKPGQPPKLLIYRASNLESGIPARFSGSGSRTDFTLTISSLQPEDFATYYCQQSYEDPWTFGGGTKXEIK

SEQ ID NO: 274 - protein, 111 aa, Artificial Sequence
  Description of Artificial Sequence: Synthetic polypeptide
  MOD_RES (108)..(108): Any amino acid
DIVLTQSPDFQSVTPKEKVTITCRASESVDSYGNSFIHWYQQKPGQPPKLLIYRASNLESGIPARFSGSGSRTDFTLTISSLEAEDAATYYCQQSYEDPWTFGGGTKXEIK

SEQ ID NO: 275 - protein, 111 aa, Artificial Sequence
  Description of Artificial Sequence: Synthetic polypeptide
  MOD_RES (108)..(108): Any amino acid
DIVLTQTPLSLSVTPGQPASISCRASESVDSYGNSFIHWYQQKPGQPPKLLIYRASNLESGIPARFSGSGSRTDFTLKISRVEAEDVGVYYCQQSYEDPWTFGGGTKXEIK

SEQ ID NO: 276 - protein, 5 aa, Artificial Sequence
  Description of Artificial Sequence: Synthetic peptide
TYGMS

SEQ ID NO: 277 - protein, 17 aa, Artificial Sequence
  Description of Artificial Sequence: Synthetic peptide
WMNTYSGVTTYADDFKG

SEQ ID NO: 278 - protein, 13 aa, Artificial Sequence
  Description of Artificial Sequence: Synthetic peptide
EGYVFDDYYATDY

SEQ ID NO: 279 - protein, 16 aa, Artificial Sequence
  Description of Artificial Sequence: Synthetic peptide
RSSQNIVHSDGNTYLE

SEQ ID NO: 280 - protein, 7 aa, Artificial Sequence
  Description of Artificial Sequence: Synthetic peptide
KVSNRFS

SEQ ID NO: 281 - protein, 9 aa, Artificial Sequence
  Description of Artificial Sequence: Synthetic peptide
FQGSHVPLT

SEQ ID NO: 282 - protein, 122 aa, Artificial Sequence
  Description of Artificial Sequence: Synthetic polypeptide
QIQLVQSGPELKKPGETVKISCKASGYTFTTYGMSWVKQAPGKGLKWMGWMNTYSGVTTYADDFKGRFAFSLETSASTAYMQIDNLKNEDTATYFCAREGYVFDDYYATDYWGQGTSVTVSS

SEQ ID NO: 283 - protein, 112 aa, Artificial Sequence
  Description of Artificial Sequence: Synthetic polypeptide
DVLMTQTPLSLPVSLGDQASISCRSSQNIVHSDGNTYLEWYLQKPGQSPKLLIYKVSNRFSGVPDRFSGSGSGTDFTLKISRVEAEDLGIYYCFQGSHVPLTFGAGTKLELK

SEQ ID NO: 284 - protein, 5 aa, Artificial Sequence
  Description of Artificial Sequence: Synthetic peptide
KYDIN

SEQ ID NO: 285 - protein, 17 aa, Artificial Sequence
  Description of Artificial Sequence: Synthetic peptide
WIFPGDGRTDYNEKFKG

SEQ ID NO: 286 - protein, 7 aa, Artificial Sequence
  Description of Artificial Sequence: Synthetic peptide
YGPAMDY

SEQ ID NO: 287 - protein, 16 aa, Artificial Sequence
  Description of Artificial Sequence: Synthetic peptide
RSSQTIVHSNGDTYLD

SEQ ID NO: 288 - protein, 7 aa, Artificial Sequence
  Description of Artificial Sequence: Synthetic peptide
KVSNRFS

SEQ ID NO: 289 - protein, 9 aa, Artificial Sequence
  Description of Artificial Sequence: Synthetic peptide
FQGSHVPYT

SEQ ID NO: 290 - protein, 135 aa, Artificial Sequence
  Description of Artificial Sequence: Synthetic polypeptide
MGWSWVFLFLLSVTAGVHSQVHLQQSGPELVKPGASVKLSCKASGYTFTKYDINWVRQRPEQGLEWIGWIFPGDGRTDYNEKFKGKATLTTDKSSSTAYMEVSRLTSEDSAVYFCARYGPAMDYWGQGTSVTVAS

SEQ ID NO: 291 - protein, 131 aa, Artificial Sequence
  Description of Artificial Sequence: Synthetic polypeptide
MKLPVRLLVLMFWIPASSSDVLMTQTPLSLPVSLGDQASISCRSSQTIVHSNGDTYLDWFLQKPGQSPKLLIYKVSNRFSGVPDRFSGSGSGTDFTLKISRVEAEDLGVYYCFQGSHVPYTFGGGTKLEIK

SEQ ID NO: 292-483 - skipped (192 entries)

SEQ ID NO: 484 - protein, 5 aa, Artificial Sequence
  Description of Artificial Sequence: Synthetic peptide
DTYMH

SEQ ID NO: 485 - protein, 5 aa, Artificial Sequence
  Description of Artificial Sequence: Synthetic peptide
PASGH

SEQ ID NO: 486 - protein, 6 aa, Artificial Sequence
  Description of Artificial Sequence: Synthetic peptide
SGGLPD

SEQ ID NO: 487 - protein, 9 aa, Artificial Sequence
  Description of Artificial Sequence: Synthetic peptide
ASSSVSYMY

SEQ ID NO: 488 - protein, 7 aa, Artificial Sequence
  Description of Artificial Sequence: Synthetic peptide
ATSNLAS

SEQ ID NO: 489 - protein, 5 aa, Artificial Sequence
  Description of Artificial Sequence: Synthetic peptide
GNPRT

SEQ ID NO: 490 - protein, 106 aa, Artificial Sequence; identical to SEQ ID NO: 255
  Description of Artificial Sequence: Synthetic polypeptide

SEQ ID NO: 491 - protein, 116 aa, Artificial Sequence; identical to SEQ ID NO: 256
  Description of Artificial Sequence: Synthetic polypeptide

SEQ ID NO: 492 - protein, 106 aa, Artificial Sequence
  Description of Artificial Sequence: Synthetic polypeptide
EIVLTQSPGTLSLSPGERATLSCRASSSVSYMYWYQQKPGQAPRLLIYATSNLASGIPDRFSGSGSGTDFTLTISRLEPEDFAVYYCQQWEGNPRTFGGGTKLEIK

SEQ ID NO: 493 - protein, 116 aa, Artificial Sequence
  Description of Artificial Sequence: Synthetic polypeptide
QVQLVQSGAEVKKPGASVKVSCKASGFDIQDTYMHWVRQAPGQGLEWMGRIEPASGHIKYDPKFQGRVTMTRDTSTSTVYMELSSLRSEDTAVYYCARSGGLPDWWGQGTTVTVSS

SEQ ID NO: 494 - protein, 106 aa, Artificial Sequence; identical to SEQ ID NO: 492
  Description of Artificial Sequence: Synthetic polypeptide

SEQ ID NO: 495 - protein, 116 aa, Artificial Sequence
  Description of Artificial Sequence: Synthetic polypeptide
QVQLVQSGAEVKKPGASVKVSCKASGFDIQDTYMHWVRQAPGQGLEWMGRIEPASGHIKYSPKFQGRVTMTRDTSTSTVYMELSSLRSEDTAVYYCARSGGLPDWWGQGTTVTVSS

SEQ ID NO: 496 - protein, 106 aa, Artificial Sequence
  Description of Artificial Sequence: Synthetic polypeptide
EIVLTQSPGTLSLSPGERATLSCGASSSVSYMYWYQQKPGQAPRLLIYATSNLASGIPDRFSGSGSGTDFTLTISRLEPEDFAVYYCQQWEGNPRTFGGGTKLEIK

SEQ ID NO: 497 - protein, 116 aa, Artificial Sequence; identical to SEQ ID NO: 495
  Description of Artificial Sequence: Synthetic polypeptide

SEQ ID NO: 498 - protein, 106 aa, Artificial Sequence; identical to SEQ ID NO: 492
  Description of Artificial Sequence: Synthetic polypeptide

SEQ ID NO: 499 - protein, 116 aa, Artificial Sequence
  Description of Artificial Sequence: Synthetic polypeptide
QVQLVQSGAEVKKPGASVKVSCKASGFDIQDTYMHWVRQAPGQGLEWMGRIEPASGHVKYSPKFQVRVTMTRDTSTSTVYMELSSLRSEDTAVYYCARSGGLPDWWGQGTTVTVSS

SEQ ID NO: 500 - protein, 106 aa, Artificial Sequence; identical to SEQ ID NO: 492
  Description of Artificial Sequence: Synthetic polypeptide

SEQ ID NO: 501 - protein, 116 aa, Artificial Sequence
  Description of Artificial Sequence: Synthetic polypeptide
QVQLVQSGAEVKKPGASVKVSCKASGFDIQDTYMHWVRQAPGQGLEWMGRIEPASGHVKYDPKFQTRVTMTRDTSTSTVYMELSSLRSEDTAVYYCARSGGLPDWWGQGTTVTVSS

SEQ ID NO: 502 - protein, 106 aa, Artificial Sequence
  Description of Artificial Sequence: Synthetic polypeptide
EIVLTQSPGTLSLSPGERATLSCRASSSVSYMYWYQQKPGQAPRLLIYATSNLASGIPDRFSGSGSGTDFTLTISRLEPEDFAVYYCQQWQGNPRTFGGGTKLEIK

SEQ ID NO: 503 - protein, 116 aa, Artificial Sequence
  Description of Artificial Sequence: Synthetic polypeptide
QVQLVQSGAEVKKPGASVKVSCKASGFDIQDTYMHWVRQAPGQGLEWMGRIDPASGHIKYDPKFQKRVTMTRDTSTSTVYMELSSLRSEDTAVYYCARSGGLPDMWGQGTTVTVSS

SEQ ID NO: 504 - protein, 106 aa, Artificial Sequence; identical to SEQ ID NO: 502
  Description of Artificial Sequence: Synthetic polypeptide

SEQ ID NO: 505 - protein, 116 aa, Artificial Sequence
  Description of Artificial Sequence: Synthetic polypeptide
QVQLVQSGAEVKKPGASVKVSCKASGFDIQDTYMHWVRQAPGQGLEWMGRIDPASGHVKIDPKFQVRVTMTRDTSTSTVYMELSSLRSEDTAVYYCARSGGLPDMWGQGTTVTVSS

SEQ ID NO: 506 - protein, 106 aa, Artificial Sequence; identical to SEQ ID NO: 502
  Description of Artificial Sequence: Synthetic polypeptide

SEQ ID NO: 507 - protein, 116 aa, Artificial Sequence
  Description of Artificial Sequence: Synthetic polypeptide
QVQLVQSGAEVKKPGASVKVSCKASGFDIQDTYMHWVRQAPGQGLEWMGRIDPASGHLKYDPKFQVRVTMTRDTSTSTVYMELSSLRSEDTAVYYCARSGGLPDMWGQGTTVTVSS

SEQ ID NO: 508 - protein, 106 aa, Artificial Sequence; identical to SEQ ID NO: 502
  Description of Artificial Sequence: Synthetic polypeptide

SEQ ID NO: 509 - protein, 116 aa, Artificial Sequence
  Description of Artificial Sequence: Synthetic polypeptide
QVQLVQSGAEVKKPGASVKVSCKASGFDIQDTYMHWVRQAPGQGLEWMGRIDPASGHLKYDPKFQRRVTMTRDTSTSTVYMELSSLRSEDTAVYYCARSGGLPDMWGQGTTVTVSS

SEQ ID NO: 510 - protein, 106 aa, Artificial Sequence; identical to SEQ ID NO: 492
  Description of Artificial Sequence: Synthetic polypeptide

SEQ ID NO: 511 - protein, 116 aa, Artificial Sequence
  Description of Artificial Sequence: Synthetic polypeptide
QVQLVQSGAEVKKPGASVKVSCKASGFDIQDTYMHWVRQAPGQGLEWMGRIDPASGHLKYDPKFQNRVTMTRDTSTSTVYMELSSLRSEDTAVYYCARSGGLPDKWGQGTTVTVSS

SEQ ID NO: 512 - protein, 106 aa, Artificial Sequence; identical to SEQ ID NO: 496
  Description of Artificial Sequence: Synthetic polypeptide

SEQ ID NO: 513 - protein, 116 aa, Artificial Sequence; identical to SEQ ID NO: 511
  Description of Artificial Sequence: Synthetic polypeptide

SEQ ID NO: 514 - protein, 106 aa, Artificial Sequence; identical to SEQ ID NO: 492
  Description of Artificial Sequence: Synthetic polypeptide

SEQ ID NO: 515 - protein, 116 aa, Artificial Sequence
  Description of Artificial Sequence: Synthetic polypeptide
QVQLVQSGAEVKKPGASVKVSCKASGFDIQDTYMHWVRQAPGQGLEWMGRIEPASGHLKYDPKFQERVTMTRDTSTSTVYMELSSLRSEDTAVYYCARSGGLPDKWGQGTTVTVSS

SEQ ID NO: 516 - protein, 106 aa, Artificial Sequence; identical to SEQ ID NO: 496
  Description of Artificial Sequence: Synthetic polypeptide

SEQ ID NO: 517 - protein, 116 aa, Artificial Sequence; identical to SEQ ID NO: 515
  Description of Artificial Sequence: Synthetic polypeptide

SEQ ID NO: 518 - protein, 106 aa, Artificial Sequence; identical to SEQ ID NO: 502
  Description of Artificial Sequence: Synthetic polypeptide

SEQ ID NO: 519 - protein, 116 aa, Artificial Sequence
  Description of Artificial Sequence: Synthetic polypeptide
QVQLVQSGAEVKKPGASVKVSCKASGFDIQDTYMHWVRQAPGQGLEWMGRIDPASGHLKYDPKFQGRVTITRDTSASTAYMELSSLRSEDTAVYYCARSGGLPDMWGQGTTVTVSS

SEQ ID NO: 520 - protein, 106 aa, Artificial Sequence; identical to SEQ ID NO: 502
  Description of Artificial Sequence: Synthetic polypeptide

SEQ ID NO: 521 - protein, 116 aa, Artificial Sequence
  Description of Artificial Sequence: Synthetic polypeptide
QVQLVQSGAEVKKPGASVKVSCKASGFDIQDTYMHWVRQAPGQGLEWMGRIDPASGHLKYDPKFQGRVTITRDTSASTVYMELSSLRSEDTAVYYCARSGGLPDMWGQGTTVTVSS

SEQ ID NO: 522 - protein, 106 aa, Artificial Sequence; identical to SEQ ID NO: 255
  Description of Artificial Sequence: Synthetic polypeptide

SEQ ID NO: 523 - protein, 116 aa, Artificial Sequence
  Description of Artificial Sequence: Synthetic polypeptide
QVQLVQSGAEVKKPGASVKVSCKASGFDIQDTYMHWVRQAPGQGLEWMGRIDPASGHTKYDPKFQGRATITTDTSASTAYLQLSSLRSEDTAVYYCARSGGLPDVWGQGTTVTVSS

SEQ ID NO: 524 - protein, 106 aa, Artificial Sequence; identical to SEQ ID NO: 255
  Description of Artificial Sequence: Synthetic polypeptide

SEQ ID NO: 525 - protein, 116 aa, Artificial Sequence
  Description of Artificial Sequence: Synthetic polypeptide
QVQLVQSGAEVKKPGASVKVSCKASGFDIQDTYMHWVRQAPGQGLEWMGRIDPASGHTKYDPKFQVRATITTDTSASTAYLQLSSLRSEDTAVYYCARSGGLPDFWGQGTTVTVSS

SEQ ID NO: 526 - protein, 106 aa, Artificial Sequence; identical to SEQ ID NO: 255
  Description of Artificial Sequence: Synthetic polypeptide

SEQ ID NO: 527 - protein, 116 aa, Artificial Sequence
  Description of Artificial Sequence: Synthetic polypeptide
QVQLVQSGAEVKKPGASVKVSCKASGFDIQDTYMHWVRQAPGQGLEWMGRIDPASGHTKYDPKFQGRATITTDTSASTAYLQLSSLRSEDTAVYYCARSGGLPDFWGQGTTVTVSS

SEQ ID NO: 528 - protein, 106 aa, Artificial Sequence; identical to SEQ ID NO: 255
  Description of Artificial Sequence: Synthetic polypeptide

SEQ ID NO: 529 - protein, 116 aa, Artificial Sequence
  Description of Artificial Sequence: Synthetic polypeptide
QVQLVQSGAEVKKPGASVKVSCKASGFDIQDTYMHWVRQAPGQGLEWMGRIDPASGHTKYDPKFQGRATITTDTSASTAYLQLSSLRSEDTAVYYCARSGGLPDLWGQGTTVTVSS

SEQ ID NO: 530 - protein, 106 aa, Artificial Sequence
  Description of Artificial Sequence: Synthetic polypeptide
EIVLTQSPGTLSLSPGERATLSCRASSSVSYMYWYQQKPGQAPRLLIYATSNLASGIPDRFSGSGSGTDFTLTISRLEPEDFAVYYCSQWSGNPRTFGGGTKLEIK

SEQ ID NO: 531 - protein, 116 aa, Artificial Sequence; identical to SEQ ID NO: 527
  Description of Artificial Sequence: Synthetic polypeptide

SEQ ID NO: 532 - protein, 106 aa, Artificial Sequence
  Description of Artificial Sequence: Synthetic polypeptide
EIVLTQSPGTLSLSPGERATLSCRASSSVSYMYWYQQKPGQAPRLLIYATSNLASGIPDRFSGSGSGTDFTLTISRLEPEDFAVYYCQQWSGNPRSFGGGTKLEIK

SEQ ID NO: 533 - protein, 116 aa, Artificial Sequence; identical to SEQ ID NO: 527
  Description of Artificial Sequence: Synthetic polypeptide

SEQ ID NO: 534 - protein, 106 aa, Artificial Sequence
  Description of Artificial Sequence: Synthetic polypeptide
EIVLTQSPGTLSLSPGERATLSCRASSSVSYMYWYQQKPGQAPRLLIYATSNLASGIPDRFSGSGSGTDFTLTISRLEPEDFAVYYCQQWSRNPRTFGGGTKLEIK

SEQ ID NO: 535 - protein, 116 aa, Artificial Sequence; identical to SEQ ID NO: 527
  Description of Artificial Sequence: Synthetic polypeptide

SEQ ID NO: 536 - protein, 106 aa, Artificial Sequence
  Description of Artificial Sequence: Synthetic polypeptide
EIVLTQSPGTLSLSPGERATLSCRASSSVSYMYWYQQKPGQAPRLLIYATSNLASGIPDRFSGSGSGTDFTLTISRLEPEDFAVYYCQQWKGNPRTFGGGTKLEIK

SEQ ID NO: 537 - protein, 116 aa, Artificial Sequence; identical to SEQ ID NO: 527
  Description of Artificial Sequence: Synthetic polypeptide

SEQ ID NO: 538 - protein, 106 aa, Artificial Sequence; identical to SEQ ID NO: 255
  Description of Artificial Sequence: Synthetic polypeptide

SEQ ID NO: 539 - protein, 116 aa, Artificial Sequence
  Description of Artificial Sequence: Synthetic polypeptide
QVQLVQSGAEVKKPGASVKVSCKASGFDIQDTYMHWVRQAPGQGLEWMGRIDPASGHSKYDPKFQVRATITTDTSASTAYLQLSSLRSEDTAVYYCARSGGLPDFWGQGTTVTVSS

SEQ ID NO: 540 - protein, 106 aa, Artificial Sequence; identical to SEQ ID NO: 255
  Description of Artificial Sequence: Synthetic polypeptide

SEQ ID NO: 541 - protein, 116 aa, Artificial Sequence
  Description of Artificial Sequence: Synthetic polypeptide
QVQLVQSGAEVKKPGASVKVSCKASGFDIQDTYMHWVRQAPGQGLEWMGRIDPASGHYKYDPKFQVRATITTDTSASTAYLQLSSLRSEDTAVYYCARSGGLPDFWGQGTTVTVSS

SEQ ID NO: 542 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 543 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 544 - protein, 107 aa, Artificial Sequence [sequence omitted]

SEQ ID NO: 545 - protein, 25 aa, Artificial Sequence [sequence omitted]

SEQ ID NO: 546 - protein, 14 aa, Artificial Sequence
  Description of Artificial Sequence: Synthetic peptide
WVRQAPGQGLEWMG

SEQ ID NO: 547 - protein, 30 aa, Artificial Sequence
  Description of Artificial Sequence: Synthetic polypeptide
RVTMTRDTSTSTVYMELSSLRSEDTAVYYC

SEQ ID NO: 548 - protein, 11 aa, Artificial Sequence
  Description of Artificial Sequence: Synthetic peptide
WGQGTTVTVSS

SEQ ID NO: 549 - protein, 23 aa, Artificial Sequence
  Description of Artificial Sequence: Synthetic peptide
EIVLTQSPGTLSLSPGERATLSC

SEQ ID NO: 550 - protein, 15 aa, Artificial Sequence
  Description of Artificial Sequence: Synthetic peptide
WYQQKPGQAPRLLIY

SEQ ID NO: 551 - protein, 32 aa, Artificial Sequence
  Description of Artificial Sequence: Synthetic polypeptide
GIPDRFSGSGSGTDFTLTISRLEPEDFAVYYC

SEQ ID NO: 552 - protein, 10 aa, Artificial Sequence
  Description of Artificial Sequence: Synthetic peptide
FGGGTKLEIK

SEQ ID NO: 553 - protein, 10 aa, Artificial Sequence
  Description of Artificial Sequence: Synthetic peptide
GFDIQDTYMH

SEQ ID NO: 554 - protein, 17 aa, Artificial Sequence
  Description of Artificial Sequence: Synthetic peptide
RIDPASGHTKYDPKFQV

SEQ ID NO: 555 - protein, 17 aa, Artificial Sequence
  Description of Artificial Sequence: Synthetic peptide
RIEPASGHIKYDPKFQG

SEQ ID NO: 556 - protein, 17 aa, Artificial Sequence
  Description of Artificial Sequence: Synthetic peptide
RIEPASGHIKYSPKFQG

SEQ ID NO: 557 - protein, 17 aa, Artificial Sequence
  Description of Artificial Sequence: Synthetic peptide
RIEPASGHVKYSPKFQV

SEQ ID NO: 558 - protein, 17 aa, Artificial Sequence
  Description of Artificial Sequence: Synthetic peptide
RIEPASGHVKYDPKFQT

SEQ ID NO: 559 - protein, 17 aa, Artificial Sequence
  Description of Artificial Sequence: Synthetic peptide
RIDPASGHIKYDPKFQK

SEQ ID NO: 560 - protein, 17 aa, Artificial Sequence
  Description of Artificial Sequence: Synthetic peptide
RIDPASGHVKIDPKFQV

SEQ ID NO: 561 - protein, 17 aa, Artificial Sequence
  Description of Artificial Sequence: Synthetic peptide
RIDPASGHLKYDPKFQV

SEQ ID NO: 562 - protein, 17 aa, Artificial Sequence
  Description of Artificial Sequence: Synthetic peptide
RIDPASGHLKYDPKFQR

SEQ ID NO: 563 - protein, 17 aa, Artificial Sequence
  Description of Artificial Sequence: Synthetic peptide
RIDPASGHLKYDPKFQN

SEQ ID NO: 564 - protein, 17 aa, Artificial Sequence
  Description of Artificial Sequence: Synthetic peptide
RIEPASGHLKYDPKFQE

SEQ ID NO: 565 - protein, 9 aa, Artificial Sequence
  Description of Artificial Sequence: Synthetic peptide
ARSGGLPDV

SEQ ID NO: 566 - protein, 9 aa, Artificial Sequence
  Description of Artificial Sequence: Synthetic peptide
ARSGGLPDW

SEQ ID NO: 567 - protein, 9 aa, Artificial Sequence
  Description of Artificial Sequence: Synthetic peptide
ARSGGLPDM

SEQ ID NO: 568 - protein, 9 aa, Artificial Sequence
  Description of Artificial Sequence: Synthetic peptide
ARSGGLPDK

SEQ ID NO: 569 - protein, 10 aa, Artificial Sequence
  Description of Artificial Sequence: Synthetic peptide
RASSSVSYMY

SEQ ID NO: 570 - protein, 10 aa, Artificial Sequence
  Description of Artificial Sequence: Synthetic peptide
GASSSVSYMY

SEQ ID NO: 571 - protein, 9 aa, Artificial Sequence
  Description of Artificial Sequence: Synthetic peptide
QQWSGNPRT

SEQ ID NO: 572 - protein, 9 aa, Artificial Sequence
  Description of Artificial Sequence: Synthetic peptide
QQWEGNPRT

SEQ ID NO: 573 - protein, 9 aa, Artificial Sequence
  Description of Artificial Sequence: Synthetic peptide
QQWQGNPRT

SEQ ID NO: 574 - protein, 17 aa, Artificial Sequence
  Description of Artificial Sequence: Synthetic peptide
RIDPASGHLKYDPKFQG

SEQ ID NO: 575 - protein, 17 aa, Artificial Sequence
  Description of Artificial Sequence: Synthetic peptide
RIDPASGHTKYDPKFQG

SEQ ID NO: 576 - protein, 17 aa, Artificial Sequence
  Description of Artificial Sequence: Synthetic peptide
RIDPASGHSKYDPKFQV

SEQ ID NO: 577 - protein, 17 aa, Artificial Sequence
  Description of Artificial Sequence: Synthetic peptide
RIDPASGHYKYDPKFQV

SEQ ID NO: 578 - protein, 9 aa, Artificial Sequence
  Description of Artificial Sequence: Synthetic peptide
ARSGGLPDV

SEQ ID NO: 579 - protein, 9 aa, Artificial Sequence
  Description of Artificial Sequence: Synthetic peptide
ARSGGLPDM

SEQ ID NO: 580 - protein, 9 aa, Artificial Sequence
  Description of Artificial Sequence: Synthetic peptide
ARSGGLPDF

SEQ ID NO: 581 - protein, 9 aa, Artificial Sequence
  Description of Artificial Sequence: Synthetic peptide
ARSGGLPDL

SEQ ID NO: 582 - protein, 9 aa, Artificial Sequence
  Description of Artificial Sequence: Synthetic peptide
SQWSGNPRT

SEQ ID NO: 583 - protein, 9 aa, Artificial Sequence
  Description of Artificial Sequence: Synthetic peptide
QQWSGNPRS

SEQ ID NO: 584 - protein, 9 aa, Artificial Sequence
  Description of Artificial Sequence: Synthetic peptide
QQWSRNPRT

SEQ ID NO: 585 - protein, 9 aa, Artificial Sequence
  Description of Artificial Sequence: Synthetic peptide
QQWKGNPRT

SEQ ID NO: 586 - protein, 30 aa, Artificial Sequence
  Description of Artificial Sequence: Synthetic polypeptide
RATITTDTSASTAYLQLSSLRSEDTAVYYC

SEQ ID NO: 587 - protein, 30 aa, Artificial Sequence
  Description of Artificial Sequence: Synthetic polypeptide
RVTITRDTSASTVYMELSSLRSEDTAVYYC

SEQ ID NO: 588 - protein, 30 aa, Artificial Sequence
  Description of Artificial Sequence: Synthetic polypeptide
RVTITRDTSASTAYMELSSLRSEDTAVYYC

SEQ ID NO: 589-1000 - skipped (412 entries)

SEQ ID NO: 1001 - DNA, 348 bp, Artificial Sequence
  Description of Artificial Sequence: Synthetic polynucleotide
gaagttcagctgcaacagtctggcgccgagctggttaagcctggcgcttctgtgaagctgagctgtaccgcctctggcttcgacatccaagacacctacatgcactgggtcaagcagaggcctgagcagggactcgagtggatcggcagaattgatcctgccagcggccacaccaaatacgaccccaagttccaagtgaaggccaccatcaccaccgacaccagcagcaataccgcctacctgcagctgagcagcctgacctctgaagataccgccgtgtactactgcagcagatctggcggactgcccgatgtttggggagccggaacaaccgtgacagtgtccagc

SEQ ID NO: 1002 - DNA, 348 bp, Artificial Sequence
  Description of Artificial Sequence: Synthetic polynucleotide
gaggttcaacttcaacaatcgggggccgagctggttaagcccggcgcttctgtaaaattgtcttgcactgcctctgggtttgacatccaagatacatatatgcattgggtgaaacagcgtcccgagcagggcttggagtggattggacgtattgaccccgcctctgggcacacgaaatatgatcctaagttccaggttaaagcgactatcacaacggacacctccagcaatacggcttatttacagttatcctcgctgacctctgaggatactgcagtgtactactgctctcgctctggtggtctgccagacgtgtggggtgcaggaactacagttactgtgtcttca

SEQ ID NO: 1003 - protein, 116 aa, Artificial Sequence; identical to SEQ ID NO: 244
  Description of Artificial Sequence: Synthetic polypeptide

SEQ ID NO: 1004 - DNA, 318 bp, Artificial Sequence
  Description of Artificial Sequence: Synthetic polynucleotide
caaattgtgctgtctcagagccccgccatcctgagtgcttctccaggcgagaaagtgaccatgacctgcagagccagcagcagcgtgtcctacatgtactggtatcagcagaagcccggcagcagccccaagccttggatctacgccacaagcaatctggccagcggcgtgcccgatagattttctggctctggcagcggcaccagctacagcctgacaatctctagagtggaagccgaggatgccgccacctactactgtcaacagtggagcggcaaccccagaacctttggcggaggcaccaagctggaaatcaag

SEQ ID NO: 1005 - DNA, 318 bp, Artificial Sequence
  Description of Artificial Sequence: Synthetic polynucleotide
caaatcgtcctgtcacagtccccggcgatcctttctgcttcaccaggagagaaggtaaccatgacatgtcgcgcctcttcctcagtttcttacatgtactggtaccagcagaaaccaggatcatctcccaaaccctggatctacgctacatcaaaccttgcatctggcgtgccagaccgtttttcagggtcgggctcggggacttcctattcattaaccatttctcgcgtagaagcggaagacgccgccacgtattattgtcagcagtggtcaggaaatccgcgcacattcggaggcggaacgaaattggagatcaaa

SEQ ID NO: 1006 - protein, 106 aa, Artificial Sequence; identical to SEQ ID NO: 245
  Description of Artificial Sequence: Synthetic polypeptide

SEQ ID NO: 1007 - DNA, 30 bp, Artificial Sequence
  Description of Artificial Sequence: Synthetic oligonucleotide
ggcttcgacatccaagacacctacatgcac

SEQ ID NO: 1008 - DNA, 30 bp, Artificial Sequence
  Description of Artificial Sequence: Synthetic oligonucleotide
gggtttgacatccaagatacatatatgcat

SEQ ID NO: 1009 - protein, 10 aa, Artificial Sequence
  Description of Artificial Sequence: Synthetic peptide
GFDIQDTYMH

SEQ ID NO: 1010-10009 - skipped (9000 entries)

SEQ ID NO: 10010 - DNA, 51 bp, Artificial Sequence
  Description of Artificial Sequence: Synthetic oligonucleotide
agaattgatcctgccagcggccacaccaaatacgaccccaagttccaagtg

SEQ ID NO: 10011 - DNA, 51 bp, Artificial Sequence
  Description of Artificial Sequence: Synthetic oligonucleotide
cgtattgaccccgcctctgggcacacgaaatatgatcctaagttccaggtt

SEQ ID NO: 10012 - protein, 17 aa, Artificial Sequence
  Description of Artificial Sequence: Synthetic peptide
RIDPASGHTKYDPKFQV

SEQ ID NO: 10013 - DNA, 21 bp, Artificial Sequence
  Description of Artificial Sequence: Synthetic oligonucleotide
tctggcggactgcccgatgtt

SEQ ID NO: 10014 - DNA, 21 bp, Artificial Sequence
  Description of Artificial Sequence: Synthetic oligonucleotide
tctggtggtctgccagacgtg

SEQ ID NO: 10015 - protein, 7 aa, Artificial Sequence
  Description of Artificial Sequence: Synthetic peptide
SGGLPDV

SEQ ID NO: 10016 - DNA, 30 bp, Artificial Sequence
  Description of Artificial Sequence: Synthetic oligonucleotide
agagccagcagcagcgtgtcctacatgtac

SEQ ID NO: 10017 - DNA, 30 bp, Artificial Sequence
  Description of Artificial Sequence: Synthetic oligonucleotide
cgcgcctcttcctcagtttcttacatgtac

SEQ ID NO: 10018 - protein, 10 aa, Artificial Sequence
  Description of Artificial Sequence: Synthetic peptide
RASSSVSYMY

SEQ ID NO: 10019 - DNA, 21 bp, Artificial Sequence
  Description of Artificial Sequence: Synthetic oligonucleotide
gccacaagcaatctggccagc

SEQ ID NO: 10020 - DNA, 21 bp, Artificial Sequence
  Description of Artificial Sequence: Synthetic oligonucleotide
gctacatcaaaccttgcatct

SEQ ID NO: 10021 - protein, 7 aa, Artificial Sequence
  Description of Artificial Sequence: Synthetic peptide
ATSNLAS

SEQ ID NO: 10022 - DNA, 27 bp, Artificial Sequence
  Description of Artificial Sequence: Synthetic oligonucleotide
caacagtggagcggcaaccccagaacc

SEQ ID NO: 10023 - DNA, 27 bp, Artificial Sequence
  Description of Artificial Sequence: Synthetic oligonucleotide
cagcagtggtcaggaaatccgcgcaca

SEQ ID NO: 10024 - protein, 9 aa, Artificial Sequence
  Description of Artificial Sequence: Synthetic peptide
QQWSGNPRT

SEQ ID NO: 10025 - DNA, 348 bp, Artificial Sequence
  Description of Artificial Sequence: Synthetic polynucleotide
caagtacaattagtccagtcgggtgccgaggtaaaaaaacctggagcatccgtaaaactgtcttgcaaagcatcggggtttgacatccaggacacctacatgcactgggtgcgtcaagctccaggacagggattagagtggatgggtcgcatcgaccccgcgagcggacacacgaaatacgaccctaaatttcaagtacgtgtcacgatgactaccgacactagtacgagcactgtttatatggaattgtcctcgttacgctcagaggatacggcagtctattattgcagccgttccggaggcttacccgacgtctggggacagggaactactgtaacagtcagtagt

SEQ ID NO: 10026 - protein, 116 aa, Artificial Sequence; identical to SEQ ID NO: 252
  Description of Artificial Sequence: Synthetic polypeptide

SEQ ID NO: 10027 - DNA, 318 bp, Artificial Sequence
  Description of Artificial Sequence: Synthetic polynucleotide
gagattgtgttaacgcaatcaccggggactttatcgctgtcgccgggggagcgcgttacaatgtcttgtcgcgcttcctcttcggtttcatacatgtattggtatcaacaaaaaccgggacaggctccacgcccctggatttacgctactagcaatttggcctcgggcgttcccgaccgcttcagcgggtcagggagcggcaccgattacacgttgaccatctctcgtctggaacctgaagacttcgcggtctattactgtcaacaatggtcgggaaatccccgtacatttggcggagggacgaagttggaaattaaa

SEQ ID NO: 10028 - protein, 106 aa, Artificial Sequence; identical to SEQ ID NO: 253
  Description of Artificial Sequence: Synthetic polypeptide

SEQ ID NO: 10029 - DNA, 30 bp, Artificial Sequence
  Description of Artificial Sequence: Synthetic oligonucleotide
gggtttgacatccaggacacctacatgcac

SEQ ID NO: 10030 - DNA, 51 bp, Artificial Sequence
  Description of Artificial Sequence: Synthetic oligonucleotide
cgcatcgaccccgcgagcggacacacgaaatacgaccctaaatttcaagta

SEQ ID NO: 10031 - DNA, 21 bp, Artificial Sequence
  Description of Artificial Sequence: Synthetic oligonucleotide
tccggaggcttacccgacgtc

SEQ ID NO: 10032 - DNA, 36 bp, Artificial Sequence
  Description of Artificial Sequence: Synthetic oligonucleotide
cgcgcttcctcttcggtttcatacatgtattggtat

SEQ ID NO: 10033 - DNA, 21 bp, Artificial Sequence
  Description of Artificial Sequence: Synthetic oligonucleotide
gctactagcaatttggcctcg

SEQ ID NO: 10034 - DNA, 27 bp, Artificial Sequence
  Description of Artificial Sequence: Synthetic oligonucleotide
caacaatggtcgggaaatccccgtaca

SEQ ID NO: 10035 - DNA, 348 bp, Artificial Sequence
  Description of Artificial Sequence: Synthetic polynucleotide
caagtacaattagtccagtcgggtgccgaggtaaaaaaacctggagcatccgtaaaactgtcttgcaaagcatcggggtttgacatccaggacacctacatgcactgggtgcgtcaagctccaggacagggattagagtggatgggtcgcatcgaccccgcgagcggacacacgaaatacgaccctaaatttcaagtacgtgtcacgatgactcgtgacactagtacgagcactgtttatatggaattgtcctcgttacgctcagaggatacggcagtctattattgcagccgttccggaggcttacccgacgtctggggacagggaactactgtaacagtcagtagt

SEQ ID NO: 10036 - protein, 116 aa, Artificial Sequence; identical to SEQ ID NO: 254
  Description of Artificial Sequence: Synthetic polypeptide

SEQ ID NO: 10037 - DNA, 318 bp, Artificial Sequence
  Description of Artificial Sequence: Synthetic polynucleotide
gagattgtgttaacgcaatcaccggggactttatcgctgtcgccgggggagcgcgcgacactgtcttgtcgcgcttcctcttcggtttcatacatgtattggtatcaacaaaaaccgggacaggctccacgcctgctgatttacgctactagcaatttggcctcgggcatccccgaccgcttcagcgggtcagggagcggcaccgattttacgttgaccatctctcgtctggaacctgaagacttcgcggtctattactgtcaacaatggtcgggaaatccccgtacatttggcggagggacgaagttggaaattaaa

SEQ ID NO: 10038 - protein, 106 aa, Artificial Sequence; identical to SEQ ID NO: 255
  Description of Artificial Sequence: Synthetic polypeptide

SEQ ID NO: 10039 - DNA, 348 bp, Artificial Sequence
  Description of Artificial Sequence: Synthetic polynucleotide
caagtacaattagtccagtcgggtgccgaggtaaaaaaacctggagcatccgtaaaagtctcttgcaaagcatcggggtttgacatccaggacacctacatgcactgggtgcgtcaagctccaggacagggattagagtggatgggtcgcatcgaccccgcgagcggacacacgaaatacgaccctaaatttcaagtacgtgtcacgatgactcgtgacactagtacgagcactgtttatatggaattgtcctcgttacgctcagaggatacggcagtctattattgcgcacgttccggaggcttacccgacgtctggggacagggaactactgtaacagtcagtagt

SEQ ID NO: 10040 - protein, 116 aa, Artificial Sequence; identical to SEQ ID NO: 256
  Description of Artificial Sequence: Synthetic polypeptide

SEQ ID NO: 10041 - DNA, 318 bp, Artificial Sequence
  Description of Artificial Sequence: Synthetic polynucleotide
gagattgtgttaacgcaatcaccggggactttatcgctgtcgccgggggagcgcgcgacactgtcttgtcgcgcttcctcttcggtttcatacatgtattggtatcaacaaaaaccgggacaggctccacgcctgctgatttacgctactagcaatttggcctcgggcgttcccgaccgcttcagcgggtcagggagcggcaccgattacacgttgaccatctctcgtctggaacctgaagacttcgcggtctattactgtcaacaatggtcgggaaatccccgtacatttggcggagggacgaagttggaaattaaa

SEQ ID NO: 10042 - protein, 106 aa, Artificial Sequence; identical to SEQ ID NO: 257
  Description of Artificial Sequence: Synthetic polypeptide

SEQ ID NO: 10043 - protein, 116 aa, Artificial Sequence
  Description of Artificial Sequence: Synthetic polypeptide
QVQLVQSGAEVKKPGASVKVSCKASGFDIQDTYMHWVRQAPGQGLEWMGRIDPASGHTKYDPKFQVRVTMTRDTSTSTVYMELSSLRSEDTAVYYCARSGGLPDKWGQGTTVTVSS

SEQ ID NO: 10044 - protein, 116 aa, Artificial Sequence
  Description of Artificial Sequence: Synthetic polypeptide
QVQLVQSGAEVKKPGASVKVSCKASGFDIQDTYMHWVRQAPGQGLEWMGRIDPASGHTKYDPKFQVRVTMTRDTSTSTVYMELSSLRSEDTAVYYCARSGGLPDMWGQGTTVTVSS

SEQ ID NO: 10045 - protein, 116 aa, Artificial Sequence
  Description of Artificial Sequence: Synthetic polypeptide
QVQLVQSGAEVKKPGASVKVSCKASGFDIQDTYMHWVRQAPGQGLEWMGRIDPASGHTKYDPKFQVRVTMTRDTSTSTVYMELSSLRSEDTAVYYCARSGGLPDQWGQGTTVTVSS

SEQ ID NO: 10046 - protein, 116 aa, Artificial Sequence
  Description of Artificial Sequence: Synthetic polypeptide
QVQLVQSGAEVKKPGASVKVSCKASGFDIQDTYMHWVRQAPGQGLEWMGRIDPASGHTKYDPKFQVRVTMTRDTSTSTVYMELSSLRSEDTAVYYCARSGGLPDWWGQGTTVTVSS

SEQ ID NO: 10047 - protein, 106 aa, Artificial Sequence
  Description of Artificial Sequence: Synthetic polypeptide
EIVLTQSPGTLSLSPGERATLSCRASSSVSYMYWYQQKPGQAPRLLIYATSNLASGIPDRFSGSGSGTDFTLTISRLEPEDFAVYYCQQWDGNPRTFGGGTKLEIK

SEQ ID NO: 10048 - protein, 106 aa, Artificial Sequence; identical to SEQ ID NO: 492
  Description of Artificial Sequence: Synthetic polypeptide

SEQ ID NO: 10049 - protein, 106 aa, Artificial Sequence
  Description of Artificial Sequence: Synthetic polypeptide
EIVLTQSPGTLSLSPGERATLSCRASSSVSYMYWYQQKPGQAPRLLIYATSNLASGIPDRFSGSGSGTDFTLTISRLEPEDFAVYYCQQWHGNPRTFGGGTKLEIK

SEQ ID NO: 10050 - protein, 106 aa, Artificial Sequence
  Description of Artificial Sequence: Synthetic polypeptide
EIVLTQSPGTLSLSPGERATLSCRASSSVSYMYWYQQKPGQAPRLLIYATSNLASGIPDRFSGSGSGTDFTLTISRLEPEDFAVYYCQQWNGNPRTFGGGTKLEIK

SEQ ID NO: 10051 - protein, 106 aa, Artificial Sequence; identical to SEQ ID NO: 502
  Description of Artificial Sequence: Synthetic polypeptide

SEQ ID NO: 10052 - protein, 116 aa, Artificial Sequence
  Description of Artificial Sequence: Synthetic polypeptide
  MOD_RES (28)..(28): D or E
  MOD_RES (29)..(29): I, P or V
  MOD_RES (30)..(30): G, Q, S or V
  MOD_RES (33)..(33): F or Y
  MOD_RES (34)..(34): I or M
  MOD_RES (102)..(102): L or M
  MOD_RES (105)..(105): E, I, K, L, M, Q, T, V, W or Y
QVQLVQSGAEVKKPGASVKVSCKASGFXXXDTXXHWVRQAPGQGLEWMGRIDPASGHTKYDPKFQVRVTMTRDTSTSTVYMELSSLRSEDTAVYYCARSGGXPDXWGQGTTVTVSS

SEQ ID NO: 10053 - protein, 106 aa, Artificial Sequence
  Description of Artificial Sequence: Synthetic polypeptide
  MOD_RES (88)..(88): Q or N
  MOD_RES (91)..(91): D, E, H, N, Q or S
  MOD_RES (92)..(92): A or G
  MOD_RES (93)..(93): D, F, K, N, R, S or T
EIVLTQSPGTLSLSPGERATLSCRASSSVSYMYWYQQKPGQAPRLLIYATSNLASGIPDRFSGSGSGTDFTLTISRLEPEDFAVYYCXQWXXXPRTFGGGTKLEIK

SEQ ID NO: 10054 - protein, 116 aa, Artificial Sequence
  Description of Artificial Sequence: Synthetic polypeptide
  MOD_RES (28)..(28): D or E
  MOD_RES (29)..(29): I, P or V
  MOD_RES (30)..(30): G, Q, S or V
  MOD_RES (33)..(33): F or Y
  MOD_RES (34)..(34): I or M
  MOD_RES (102)..(102): L or M
  MOD_RES (105)..(105): E, I, K, L, M, Q, T, V, W or Y
QVQLVQSGAEVKKPGASVKVSCKASGFXXXDTXXHWVRQAPGQGLEWMGRIDPASGHTKYDPKFQVRVTMTRDTSTSTVYMELSSLRSEDTAVYYCSRSGGXPDXWGQGTTVTVSS

SEQ ID NO: 10055-20099 - skipped (10045 entries)

SEQ ID NO: 20100 - protein, 5 aa, Artificial Sequence
  Description of Artificial Sequence: Synthetic peptide
SYIWS

SEQ ID NO: 20101 - protein, 16 aa, Artificial Sequence
  Description of Artificial Sequence: Synthetic peptide
RIYASGNTNYNPSLKS

SEQ ID NO: 20102 - protein, 16 aa, Artificial Sequence
  Description of Artificial Sequence: Synthetic peptide
DYRVAGTYYYYYGLDV

SEQ ID NO: 20103 - protein, 14 aa, Artificial Sequence
  Description of Artificial Sequence: Synthetic peptide
TGTSSDVGVYDYVS

SEQ ID NO: 20104 - protein, 7 aa, Artificial Sequence
  Description of Artificial Sequence: Synthetic peptide
EVSNRPS

SEQ ID NO: 20105 - protein, 10 aa, Artificial Sequence
  Description of Artificial Sequence: Synthetic peptide
SSYTSRSTWV

SEQ ID NO: 20106 - protein, 5 aa, Artificial Sequence
  Description of Artificial Sequence: Synthetic peptide
SYYWT

SEQ ID NO: 20107 - protein, 16 aa, Artificial Sequence
  Description of Artificial Sequence: Synthetic peptide
RIYTSGITNYNPSLKS

SEQ ID NO: 20108 - protein, 16 aa, Artificial Sequence
  Description of Artificial Sequence: Synthetic peptide
ERVVGASRYYYYGVDV

SEQ ID NO: 20109 - protein, 14 aa, Artificial Sequence
  Description of Artificial Sequence: Synthetic peptide
TGTSSDVGLYNYVS

SEQ ID NO: 20110 - protein, 7 aa, Artificial Sequence
  Description of Artificial Sequence: Synthetic peptide
EVNNRPS

SEQ ID NO: 20111 - protein, 10 aa, Artificial Sequence
  Description of Artificial Sequence: Synthetic peptide
SSYTSSSTWV

SEQ ID NO: 20112 - protein, 5 aa, Artificial Sequence
  Description of Artificial Sequence: Synthetic peptide
SYYWT

SEQ ID NO: 20113 - protein, 16 aa, Artificial Sequence
  Description of Artificial Sequence: Synthetic peptide
RIYTSGITNYNPSLKS

SEQ ID NO: 20114 - protein, 16 aa, Artificial Sequence
  Description of Artificial Sequence: Synthetic peptide
ERVVGASRYYYYGVDV

SEQ ID NO: 20115 - protein, 14 aa, Artificial Sequence
  Description of Artificial Sequence: Synthetic peptide
TGTSSDIGLYDYVS

SEQ ID NO: 20116 - protein, 7 aa, Artificial Sequence
  Description of Artificial Sequence: Synthetic peptide
EVNNRPS

SEQ ID NO: 20117 - protein, 10 aa, Artificial Sequence
  Description of Artificial Sequence: Synthetic peptide
SSYTSSSTWV

SEQ ID NO: 20118 - protein, 5 aa, Artificial Sequence
  Description of Artificial Sequence: Synthetic peptide
SYSWS

SEQ ID NO: 20119 - protein, 16 aa, Artificial Sequence
  Description of Artificial Sequence: Synthetic peptide
RTSTSGRNNYNPSLKS

SEQ ID NO: 20120 - protein, 16 aa, Artificial Sequence
  Description of Artificial Sequence: Synthetic peptide
DFTIAARRYYYYGMDV

SEQ ID NO: 20121 - protein, 14 aa, Artificial Sequence
  Description of Artificial Sequence: Synthetic peptide
TGTSSDIGLYNYVS

SEQ ID NO: 20122 - protein, 7 aa, Artificial Sequence
  Description of Artificial Sequence: Synthetic peptide
EVINRPS

SEQ ID NO: 20123 - protein, 10 aa, Artificial Sequence
  Description of Artificial Sequence: Synthetic peptide
SSYTSSSTWV

SEQ ID NO: 20124 - protein, 5 aa, Artificial Sequence
  Description of Artificial Sequence: Synthetic peptide
NNYWS

SEQ ID NO: 20125 - protein, 16 aa, Artificial Sequence
  Description of Artificial Sequence: Synthetic peptide
RVYSSGLTNYKPSLKS

SEQ ID NO: 20126 - protein, 16 aa, Artificial Sequence
  Description of Artificial Sequence: Synthetic peptide
ERATVTTRYHYDGMDV

SEQ ID NO: 20127 - protein, 14 aa, Artificial Sequence
  Description of Artificial Sequence: Synthetic peptide
TGSSSDIGTYNYVS

SEQ ID NO: 20128 - protein, 7 aa, Artificial Sequence
  Description of Artificial Sequence: Synthetic peptide
EVNNRPS

SEQ ID NO: 20129 - protein, 10 aa, Artificial Sequence
  Description of Artificial Sequence: Synthetic peptide
SSYSSSSTWV

SEQ ID NO: 20130 - protein, 5 aa, Artificial Sequence
  Description of Artificial Sequence: Synthetic peptide
SYYWS

SEQ ID NO: 20131 - protein, 16 aa, Artificial Sequence
  Description of Artificial Sequence: Synthetic peptide
RIFASGSTNYNPSLRS

SEQ ID NO: 20132 - protein, 16 aa, Artificial Sequence
  Description of Artificial Sequence: Synthetic peptide
ERVGVQDYYHYSGMDV

SEQ ID NO: 20133 - protein, 14 aa, Artificial Sequence
  Description of Artificial Sequence: Synthetic peptide
TGTSSDVGLYNYVS

SEQ ID NO: 20134 - protein, 7 aa, Artificial Sequence
  Description of Artificial Sequence: Synthetic peptide
EVSKRPS

SEQ ID NO: 20135 - protein, 10 aa, Artificial Sequence
  Description of Artificial Sequence: Synthetic peptide
SSYTSSSTWV

SEQ ID NO: 20136 - protein, 124 aa, Artificial Sequence
  Description of Artificial Sequence: Synthetic polypeptide
QVQLQESGPGLVKPSETLSLTCTVSGGSISSYYWTWIRQPAGKGLEWIGRIYTSGITNYNPSLKSRVTMSVDTSKNQFSLKLSSVTAADTAVYYCARERVVGASRYYYYGVDVWGQGTTVTVSS

SEQ ID NO: 20137 - protein, 110 aa, Artificial Sequence
  Description of Artificial Sequence: Synthetic polypeptide
QSALTQPASVSGSPGQSITISCTGTSSDVGLYNYVSWYQQHPDKAPKLMIFEVNNRPSGVSNRFSGSNSGNTASLTISGLQAEDEADYYCSSYTSSSTWVFGGGTKLTVL

SEQ ID NO: 20138 - protein, 124 aa, Artificial Sequence; identical to SEQ ID NO: 20136
  Description of Artificial Sequence: Synthetic polypeptide

SEQ ID NO: 20139 - protein, 110 aa, Artificial Sequence
  Description of Artificial Sequence: Synthetic polypeptide
QSALTQPASVSGSPGQSITISCTGTSSDIGLYDYVSWYQQHPDRAPKLIIFEVNNRPSGVSYRFSGSNSGNTASLTISGLQAEDEADYYCSSYTSSSTWVFGGGTKLTVL

SEQ ID NO: 20140 - protein, 124 aa, Artificial Sequence
  Description of Artificial Sequence: Synthetic polypeptide
QVQLQESGPGLVKPSETLSLTCTVSGGSISSYSWSWIRQPAGKGLEWIGRTSTSGRNNYNPSLKSRVTMSVDTSKNQFSLKLNSVTAADTAVYYCARDFTIAARRYYYYGMDVWGQGTTVTVSS

SEQ ID NO: 20141 - protein, 110 aa, Artificial Sequence
  Description of Artificial Sequence: Synthetic polypeptide
QSALTQPASVSGSPGQSITISCTGTSSDIGLYNYVSWYQQHPGKAPKLIIYEVINRPSGVSNRFSGSESGNTASLTISGLQAEDEANYYCSSYTSSSTWVFGGGTKLTVL

SEQ ID NO: 20142 - protein, 124 aa, Artificial Sequence
  Description of Artificial Sequence: Synthetic polypeptide
QVQLQESGPRLVKPSETLSLTCTVSGGSITNNYWSWIRQPAGKGLEWIGRVYSSGLTNYKPSLKSRVTMSVDTSKNQFSLRLNSVTAADTAVYYCARERATVTTRYHYDGMDVWGQGTSVTVSS

SEQ ID NO: 20143 - protein, 110 aa, Artificial Sequence
  Description of Artificial Sequence: Synthetic polypeptide
QSALTQPASVSGSPGQSITISCTGSSSDIGTYNYVSWYQQYPGKAPELMIYEVNNRPSGVSDRFSGSTSGNTASLTISGLQANDEADYYCSSYSSSSTWVFGGGTKLTVL

SEQ ID NO: 20144 - protein, 124 aa, Artificial Sequence
  Description of Artificial Sequence: Synthetic polypeptide
QVQLQESGPGLVKPSETLSLTCTVSGGSISSYYWSWIRQPAGKGLEWIGRIFASGSTNYNPSLRSRVTMSRDTSKNQFSLKLSSVTAADTAVYYCAKERVGVQDYYHYSGMDVWGQGTTVTVSS

SEQ ID NO: 20145 - protein, 110 aa, Artificial Sequence
  Description of Artificial Sequence: Synthetic polypeptide
QSALTQPASVSGSPGQSITISCTGTSSDVGLYNYVSWYQQQPGKAPKLMIYEVSKRPSGVSNRFSGSTSGNTASLTISGLQADDEADYSCSSYTSSSTWVFGGGTKLTVL

SEQ ID NO: 20146 - protein, 124 aa, Artificial Sequence
  Description of Artificial Sequence: Synthetic polypeptide
QVQLQESGPGLVKPSETLSLTCTVSGGSISSYIWSWIRQPAGKGLEWIGRIYASGNTNYNPSLKSRVTISVDTSKNQFSLKLSSMTAADTAVYYCARDYRVAGTYYYYYGLDVWGQGTTVTVSS

SEQ ID NO: 20147 - protein, 124 aa, Artificial Sequence
  Description of Artificial Sequence: Synthetic polypeptide
QVQLQESGPGLVKPSETLSLTCTVSGGSISSYIWSWIRQPAGKGLEWIGRIYASGNTNYNPSLKSRVTMSVDTSKNQFSLKLSSMTAADTAVYYCARDYRVAGTYYYYYGLDVWGQGTTVTVSS

SEQ ID NO: 20148 - protein, 124 aa, Artificial Sequence
  Description of Artificial Sequence: Synthetic polypeptide
QVQLQESGPGLVKPSETLSLTCTVSGGSISSYIWSWIRQPAGKGLEWIGRIYASGNTNYNPSLKSRVTMSVDTSKNQFSLKLSSVTAADTAVYYCARDYRVAGTYYYYYGLDVWGQGTTVTVSS

SEQ ID NO: 20149 - protein, 124 aa, Artificial Sequence
  Description of Artificial Sequence: Synthetic polypeptide
QVQLQESGPGLVKPSETLSLTCTVSGGSISSYIWSWIRQPAGKGLEWIGRIYASGQTNYNPSLKSRVTMSVDTSKNQFSLKLSSMTAADTAVYYCARDYRVAGTYYYYYGLDVWGQGTTVTVSS

SEQ ID NO: 20150 - protein, 124 aa, Artificial Sequence
  Description of Artificial Sequence: Synthetic polypeptide
QVQLQESGPGLVKPSETLSLTCTVSGGSISSYIWSWIRQPAGKGLEWIGRIYASGQTNYNPSLKSRVTISVDTSKNQFSLKLSSVTAADTAVYYCARDYRVAGTYYYYYGLDVWGQGTTVTVSS

SEQ ID NO: 20151 - protein, 124 aa, Artificial Sequence
  Description of Artificial Sequence: Synthetic polypeptide
QVQLQESGPGLVKPSETLSLTCTVSGGSISSYIWSWIRQPAGKGLEWIGRIYASGNTNYNPSLKSRVTISVDTSKNQFSLKLSSVTAADTAVYYCARDYRVAGTYYYYYGLDVWGQGTTVTVSS

SEQ ID NO: 20152 - protein, 124 aa, Artificial Sequence
  Description of Artificial Sequence: Synthetic polypeptide
QVQLQESGPGLVKPSETLSLTCTVSGGSISSYIWSWIRQPAGKGLEWIGRIYASGQTNYNPSLKSRVTISVDTSKNQFSLKLSSMTAADTAVYYCARDYRVAGTYYYYYGLDVWGQGTTVTVSS

SEQ ID NO: 20153 - protein, 124 aa, Artificial Sequence
  Description of Artificial Sequence: Synthetic polypeptide
QVQLQESGPGLVKPSETLSLTCTVSGGSISSYIWSWIRQPAGKGLEWIGRIYASGQTNYNPSLKSRVTMSVDTSKNQFSLKLSSVTAADTAVYYCARDYRVAGTYYYYYGLDVWGQGTTVTVSS

SEQ ID NO: 20154 - protein, 110 aa, Artificial Sequence
  Description of Artificial Sequence: Synthetic polypeptide
QSALTQPASVSGSPGQSITISCTGTSSDVGVYDYVSWYQQHPGKAPKLMIYEVSNRPSGVSNRFSGSKSGNTASLTISGLQTEDEADYYCSSYTSRSTWVFGGGTKLTVL

SEQ ID NO: 20155-100099 - skipped (79945 entries)

SEQ ID NO: 100100 - protein, 25 aa, Artificial Sequence
  Description of Artificial Sequence: Synthetic peptide
QVQLVQSGAEVKKPGASVKLSCKAS

SEQ ID NO: 100101 - protein, 14 aa, Artificial Sequence
  Description of Artificial Sequence: Synthetic peptide
WVRQAPGQGLEWMG

SEQ ID NO: 100102 - protein, 32 aa, Artificial Sequence
  Description of Artificial Sequence: Synthetic polypeptide
RVTMTRDTSTSTVYMELSSLRSEDTAVYYCSR

SEQ ID NO: 100103 - protein, 11 aa, Artificial Sequence
  Description of Artificial Sequence: Synthetic peptide
WGQGTTVTVSS

SEQ ID NO: 100104 - protein, 23 aa, Artificial Sequence
  Description of Artificial Sequence: Synthetic peptide
EIVLTQSPGTLSLSPGERATLSC

SEQ ID NO: 100105 - protein, 15 aa, Artificial Sequence
  Description of Artificial Sequence: Synthetic peptide
WYQQKPGQAPRLLIY

SEQ ID NO: 100106 - protein, 32 aa, Artificial Sequence; identical to SEQ ID NO: 551
  Description of Artificial Sequence: Synthetic polypeptide

SEQ ID NO: 100107 - protein, 10 aa, Artificial Sequence
  Description of Artificial Sequence: Synthetic peptide
FGGGTKLEIK

SEQ ID NO: 100108 - protein, 25 aa, Artificial Sequence [sequence omitted]

SEQ ID NO: 100109 - protein, 32 aa, Artificial Sequence
  Description of Artificial Sequence: Synthetic polypeptide
RVTMTRDTSTSTVYMELSSLRSEDTAVYYCAR

SEQ ID NO: 100110 - protein, 32 aa, Artificial Sequence
  Description of Artificial Sequence: Synthetic polypeptide
GVPDRFSGSGSGTDYTLTISRLEPEDFAVYYC

SEQ ID NO: 100111-100149 - skipped (39 entries)

SEQ ID NO: 100150 - protein, 10 aa, Artificial Sequence
  Description of Artificial Sequence: Synthetic peptide
  MOD_RES (3)..(3): D or E
  MOD_RES (4)..(4): I, P or V
  MOD_RES (5)..(5): G, Q, S or V
  MOD_RES (8)..(8): F or Y
  MOD_RES (9)..(9): I or M
GFXXXDTXXH

SEQ ID NO: 100151 - skipped

SEQ ID NO: 100152 - protein, 7 aa, Artificial Sequence
  Description of Artificial Sequence: Synthetic peptide
  MOD_RES (4)..(4): L or M
  MOD_RES (7)..(7): E, I, K, L, M, Q, T, V, W or Y
SGGXPDX

SEQ ID NO: 100153-100154 - skipped (2 entries)

SEQ ID NO: 100155 - protein, 9 aa, Artificial Sequence
  Description of Artificial Sequence: Synthetic peptide
  MOD_RES (1)..(1): Q or N
  MOD_RES (4)..(4): D, E, H, N, Q or S
  MOD_RES (5)..(5): A or G
  MOD_RES (6)..(6): D, F, K, N, R, S or T
XQWXXXPRT

SEQ ID NO: 100156-100199 - skipped (44 entries)

SEQ ID NO: 100200 - protein, 10 aa, Artificial Sequence
  Description of Artificial Sequence: Synthetic peptide
GFDIGDTFIH

SEQ ID NO: 100201 - protein, 10 aa, Artificial Sequence
  Description of Artificial Sequence: Synthetic peptide
GFDIGDTFMH

SEQ ID NO: 100202 - protein, 10 aa, Artificial Sequence
  Description of Artificial Sequence: Synthetic peptide
GFDIGDTYIH

SEQ ID NO: 100203 - protein, 10 aa, Artificial Sequence
  Description of Artificial Sequence: Synthetic peptide
GFDIGDTYMH

SEQ ID NO: 100204 - protein, 10 aa, Artificial Sequence
  Description of Artificial Sequence: Synthetic peptide
GFDIQDTFIH

SEQ ID NO: 100205 - protein, 10 aa, Artificial Sequence
  Description of Artificial Sequence: Synthetic peptide
GFDIQDTFMH

SEQ ID NO: 100206 - protein, 10 aa, Artificial Sequence
  Description of Artificial Sequence: Synthetic peptide
GFDIQDTYIH

SEQ ID NO: 100207 - protein, 10 aa, Artificial Sequence
  Description of Artificial Sequence: Synthetic peptide
GFDIQDTYMH

SEQ ID NO: 100208 - protein, 10 aa, Artificial Sequence
  Description of Artificial Sequence: Synthetic peptide
GFDISDTFIH

SEQ ID NO: 100209 - protein, 10 aa, Artificial Sequence
  Description of Artificial Sequence: Synthetic peptide
GFDISDTFMH

SEQ ID NO: 100210 - protein, 10 aa, Artificial Sequence
  Description of Artificial Sequence: Synthetic peptide
GFDISDTYIH

SEQ ID NO: 100211 - protein, 10 aa, Artificial Sequence
  Description of Artificial Sequence: Synthetic peptide
GFDISDTYMH

SEQ ID NO: 100212 - protein, 10 aa, Artificial Sequence
  Description of Artificial Sequence: Synthetic peptide
GFDIVDTFIH

SEQ ID NO: 100213 - protein, 10 aa, Artificial Sequence
  Description of Artificial Sequence: Synthetic peptide
GFDIVDTFMH

SEQ ID NO: 100214 - protein, 10 aa, Artificial Sequence
  Description of Artificial Sequence: Synthetic peptide
GFDIVDTYIH

SEQ ID NO: 100215 - protein, 10 aa, Artificial Sequence
  Description of Artificial Sequence: Synthetic peptide
GFDIVDTYMH

SEQ ID NO: 100216 - protein, 10 aa, Artificial Sequence
  Description of Artificial Sequence: Synthetic peptide
GFDPGDTFIH

SEQ ID NO: 100217 - protein, 10 aa, Artificial Sequence
  Description of Artificial Sequence: Synthetic peptide
GFDPGDTFMH

SEQ ID NO: 100218 - protein, 10 aa, Artificial Sequence
  Description of Artificial Sequence: Synthetic peptide
GFDPGDTYIH

SEQ ID NO: 100219 - protein, 10 aa, Artificial Sequence
  Description of Artificial Sequence: Synthetic peptide
GFDPGDTYMH

SEQ ID NO: 100220 - protein, 10 aa, Artificial Sequence
  Description of Artificial Sequence: Synthetic peptide
GFDPQDTFIH

SEQ ID NO: 100221 - protein, 10 aa, Artificial Sequence
  Description of Artificial Sequence: Synthetic peptide
GFDPQDTFMH

SEQ ID NO: 100222 - protein, 10 aa, Artificial Sequence
  Description of Artificial Sequence: Synthetic peptide
GFDPQDTYIH

SEQ ID NO: 100223 - protein, 10 aa, Artificial Sequence
  Description of Artificial Sequence: Synthetic peptide
GFDPQDTYMH

SEQ ID NO: 100224 - protein, 10 aa, Artificial Sequence
  Description of Artificial Sequence: Synthetic peptide
GFDPSDTFIH

SEQ ID NO: 100225 - protein, 10 aa, Artificial Sequence
  Description of Artificial Sequence: Synthetic peptide
GFDPSDTFMH

SEQ ID NO: 100226 - protein, 10 aa, Artificial Sequence
  Description of Artificial Sequence: Synthetic peptide
GFDPSDTYIH

SEQ ID NO: 100227 - protein, 10 aa, Artificial Sequence
  Description of Artificial Sequence: Synthetic peptide
GFDPSDTYMH

SEQ ID NO: 100228 - protein, 10 aa, Artificial Sequence
  Description of Artificial Sequence: Synthetic peptide
GFDPVDTFIH

SEQ ID NO: 100229 - protein, 10 aa, Artificial Sequence
  Description of Artificial Sequence: Synthetic peptide
GFDPVDTFMH

SEQ ID NO: 100230 - protein, 10 aa, Artificial Sequence
  Description of Artificial Sequence: Synthetic peptide
GFDPVDTYIH

SEQ ID NO: 100231 - protein, 10 aa, Artificial Sequence
  Description of Artificial Sequence: Synthetic peptide
GFDPVDTYMH

SEQ ID NO: 100232 - protein, 10 aa, Artificial Sequence
  Description of Artificial Sequence: Synthetic peptide
GFDVGDTFIH

SEQ ID NO: 100233 - protein, 10 aa, Artificial Sequence
  Description of Artificial Sequence: Synthetic peptide
GFDVGDTFMH

SEQ ID NO: 100234 - protein, 10 aa, Artificial Sequence
  Description of Artificial Sequence: Synthetic peptide
GFDVGDTYIH

SEQ ID NO: 100235 - protein, 10 aa, Artificial Sequence
  Description of Artificial Sequence: Synthetic peptide
GFDVGDTYMH

SEQ ID NO: 100236 - protein, 10 aa, Artificial Sequence
  Description of Artificial Sequence: Synthetic peptide
GFDVQDTFIH

SEQ ID NO: 100237 - protein, 10 aa, Artificial Sequence
  Description of Artificial Sequence: Synthetic peptide
GFDVQDTFMH

SEQ ID NO: 100238 - protein, 10 aa, Artificial Sequence
  Description of Artificial Sequence: Synthetic peptide
GFDVQDTYIH

SEQ ID NO: 100239 - protein, 10 aa, Artificial Sequence
  Description of Artificial Sequence: Synthetic peptide
GFDVQDTYMH

SEQ ID NO: 100240 - protein, 10 aa, Artificial Sequence
  Description of Artificial Sequence: Synthetic peptide
GFDVSDTFIH

SEQ ID NO: 100241 - protein, 10 aa, Artificial Sequence
  Description of Artificial Sequence: Synthetic peptide
GFDVSDTFMH

SEQ ID NO: 100242 - protein, 10 aa, Artificial Sequence
  Description of Artificial Sequence: Synthetic peptide
GFDVSDTYIH

SEQ ID NO: 100243 - protein, 10 aa, Artificial Sequence
  Description of Artificial Sequence: Synthetic peptide
GFDVSDTYMH

SEQ ID NO: 100244 - protein, 10 aa, Artificial Sequence
  Description of Artificial Sequence: Synthetic peptide
GFDVVDTFIH

SEQ ID NO: 100245 - protein, 10 aa, Artificial Sequence
  Description of Artificial Sequence: Synthetic peptide
GFDVVDTFMH

SEQ ID NO: 100246 - protein, 10 aa, Artificial Sequence
  Description of Artificial Sequence: Synthetic peptide
GFDVVDTYIH

SEQ ID NO: 100247 - protein, 10 aa, Artificial Sequence
  Description of Artificial Sequence: Synthetic peptide
GFDVVDTYMH

SEQ ID NO: 100248 - protein, 10 aa, Artificial Sequence
  Description of Artificial Sequence: Synthetic peptide
GFEIGDTFIH

SEQ ID NO: 100249 - protein, 10 aa, Artificial Sequence
  Description of Artificial Sequence: Synthetic peptide
GFEIGDTFMH

SEQ ID NO: 100250 - protein, 10 aa, Artificial Sequence
  Description of Artificial Sequence: Synthetic peptide
GFEIGDTYIH

SEQ ID NO: 100251 - protein, 10 aa, Artificial Sequence
  Description of Artificial Sequence: Synthetic peptide
GFEIGDTYMH

SEQ ID NO: 100252 - protein, 10 aa, Artificial Sequence
  Description of Artificial Sequence: Synthetic peptide
GFEIQDTFIH

SEQ ID NO: 100253 - protein, 10 aa, Artificial Sequence
  Description of Artificial Sequence: Synthetic peptide
GFEIQDTFMH

SEQ ID NO: 100254 - protein, 10 aa, Artificial Sequence
  Description of Artificial Sequence: Synthetic peptide
GFEIQDTYIH

SEQ ID NO: 100255 - protein, 10 aa, Artificial Sequence
  Description of Artificial Sequence: Synthetic peptide
GFEIQDTYMH

SEQ ID NO: 100256 - protein, 10 aa, Artificial Sequence
  Description of Artificial Sequence: Synthetic peptide
GFEISDTFIH

SEQ ID NO: 100257 - protein, 10 aa, Artificial Sequence
  Description of Artificial Sequence: Synthetic peptide
GFEISDTFMH

SEQ ID NO: 100258 - protein, 10 aa, Artificial Sequence
  Description of Artificial Sequence: Synthetic peptide
GFEISDTYIH

SEQ ID NO: 100259 - protein, 10 aa, Artificial Sequence
  Description of Artificial Sequence: Synthetic peptide
GFEISDTYMH

SEQ ID NO: 100260 - protein, 10 aa, Artificial Sequence
  Description of Artificial Sequence: Synthetic peptide
GFEIVDTFIH

SEQ ID NO: 100261 - protein, 10 aa, Artificial Sequence
  Description of Artificial Sequence: Synthetic peptide
GFEIVDTFMH

SEQ ID NO: 100262 - protein, 10 aa, Artificial Sequence
  Description of Artificial Sequence: Synthetic peptide
GFEIVDTYIH

SEQ ID NO: 100263 - protein, 10 aa, Artificial Sequence
  Description of Artificial Sequence: Synthetic peptide
GFEIVDTYMH

SEQ ID NO: 100264 - protein, 10 aa, Artificial Sequence
  Description of Artificial Sequence: Synthetic peptide
GFEPGDTFIH

SEQ ID NO: 100265 - protein, 10 aa, Artificial Sequence
  Description of Artificial Sequence: Synthetic peptide
GFEPGDTFMH

SEQ ID NO: 100266 - protein, 10 aa, Artificial Sequence
  Description of Artificial Sequence: Synthetic peptide
GFEPGDTYIH

SEQ ID NO: 100267 - protein, 10 aa, Artificial Sequence
  Description of Artificial Sequence: Synthetic peptide
GFEPGDTYMH

SEQ ID NO: 100268 - protein, 10 aa, Artificial Sequence
  Description of Artificial Sequence: Synthetic peptide
GFEPQDTFIH

SEQ ID NO: 100269 - protein, 10 aa, Artificial Sequence
  Description of Artificial Sequence: Synthetic peptide
GFEPQDTFMH

SEQ ID NO: 100270 - protein, 10 aa, Artificial Sequence
  Description of Artificial Sequence: Synthetic peptide
GFEPQDTYIH

SEQ ID NO: 100271 - protein, 10 aa, Artificial Sequence
  Description of Artificial Sequence: Synthetic peptide
GFEPQDTYMH

SEQ ID NO: 100272 - protein, 10 aa, Artificial Sequence
  Description of Artificial Sequence: Synthetic peptide
GFEPSDTFIH

SEQ ID NO: 100273 - protein, 10 aa, Artificial Sequence
  Description of Artificial Sequence: Synthetic peptide
GFEPSDTFMH

SEQ ID NO: 100274 - protein, 10 aa, Artificial Sequence
  Description of Artificial Sequence: Synthetic peptide
GFEPSDTYIH

SEQ ID NO: 100275 - protein, 10 aa, Artificial Sequence
  Description of Artificial Sequence: Synthetic peptide
GFEPSDTYMH

SEQ ID NO: 100276 - protein, 10 aa, Artificial Sequence
  Description of Artificial Sequence: Synthetic peptide
GFEPVDTFIH

SEQ ID NO: 100277 - protein, 10 aa, Artificial Sequence
  Description of Artificial Sequence: Synthetic peptide
GFEPVDTFMH

SEQ ID NO: 100278 - protein, 10 aa, Artificial Sequence
  Description of Artificial Sequence: Synthetic peptide
GFEPVDTYIH

SEQ ID NO: 100279 - protein, 10 aa, Artificial Sequence
  Description of Artificial Sequence: Synthetic peptide
GFEPVDTYMH

SEQ ID NO: 100280 - protein, 10 aa, Artificial Sequence
  Description of Artificial Sequence: Synthetic peptide
GFEVGDTFIH

SEQ ID NO: 100281 - protein, 10 aa, Artificial Sequence
  Description of Artificial Sequence: Synthetic peptide
GFEVGDTFMH

SEQ ID NO: 100282 - protein, 10 aa, Artificial Sequence
  Description of Artificial Sequence: Synthetic peptide
GFEVGDTYIH

SEQ ID NO: 100283 - protein, 10 aa, Artificial Sequence
  Description of Artificial Sequence: Synthetic peptide
GFEVGDTYMH

SEQ ID NO: 100284 - protein, 10 aa, Artificial Sequence
  Description of Artificial Sequence: Synthetic peptide
GFEVQDTFIH

SEQ ID NO: 100285 - protein, 10 aa, Artificial Sequence
  Description of Artificial Sequence: Synthetic peptide
GFEVQDTFMH

SEQ ID NO: 100286 - protein, 10 aa, Artificial Sequence
  Description of Artificial Sequence: Synthetic peptide
GFEVQDTYIH

SEQ ID NO: 100287 - protein, 10 aa, Artificial Sequence
  Description of Artificial Sequence: Synthetic peptide
GFEVQDTYMH

SEQ ID NO: 100288 - protein, 10 aa, Artificial Sequence
  Description of Artificial Sequence: Synthetic peptide
GFEVSDTFIH

SEQ ID NO: 100289 - protein, 10 aa, Artificial Sequence
  Description of Artificial Sequence: Synthetic peptide
GFEVSDTFMH

SEQ ID NO: 100290 - protein, 10 aa, Artificial Sequence
  Description of Artificial Sequence: Synthetic peptide
GFEVSDTYIH

SEQ ID NO: 100291 - protein, 10 aa, Artificial Sequence
  Description of Artificial Sequence: Synthetic peptide
GFEVSDTYMH

SEQ ID NO: 100292 - protein, 10 aa, Artificial Sequence
  Description of Artificial Sequence: Synthetic peptide
GFEVVDTFIH

SEQ ID NO: 100293 - protein, 10 aa, Artificial Sequence
  Description of Artificial Sequence: Synthetic peptide
GFEVVDTFMH

SEQ ID NO: 100294 - protein, 10 aa, Artificial Sequence
  Description of Artificial Sequence: Synthetic peptide
GFEVVDTYIH

SEQ ID NO: 100295 - protein, 10 aa, Artificial Sequence
  Description of Artificial Sequence: Synthetic peptide
GFEVVDTYMH

SEQ ID NO: 100296 - protein, 7 aa, Artificial Sequence
  Description of Artificial Sequence: Synthetic peptide
SGGLPDE

SEQ ID NO: 100297 - protein, 7 aa, Artificial Sequence
  Description of Artificial Sequence: Synthetic peptide
SGGLPDI

SEQ ID NO: 100298 - protein, 7 aa, Artificial Sequence
  Description of Artificial Sequence: Synthetic peptide
SGGLPDK

SEQ ID NO: 100299 - protein, 7 aa, Artificial Sequence
  Description of Artificial Sequence: Synthetic peptide
SGGLPDL

SEQ ID NO: 100300 - protein, 7 aa, Artificial Sequence
  Description of Artificial Sequence: Synthetic peptide
SGGLPDM

SEQ ID NO: 100301 - protein, 7 aa, Artificial Sequence
  Description of Artificial Sequence: Synthetic peptide
SGGLPDQ

SEQ ID NO: 100302 - protein, 7 aa, Artificial Sequence
  Description of Artificial Sequence: Synthetic peptide
SGGLPDT

SEQ ID NO: 100303 - protein, 7 aa, Artificial Sequence
  Description of Artificial Sequence: Synthetic peptide
SGGLPDW

SEQ ID NO: 100304 - protein, 7 aa, Artificial Sequence
  Description of Artificial Sequence: Synthetic peptide
SGGLPDY

SEQ ID NO: 100305 - protein, 7 aa, Artificial Sequence
  Description of Artificial Sequence: Synthetic peptide
SGGMPDE

SEQ ID NO: 100306 - protein, 7 aa, Artificial Sequence
  Description of Artificial Sequence: Synthetic peptide
SGGMPDI

SEQ ID NO: 100307 - protein, 7 aa, Artificial Sequence
  Description of Artificial Sequence: Synthetic peptide
SGGMPDK

SEQ ID NO: 100308 - protein, 7 aa, Artificial Sequence
  Description of Artificial Sequence: Synthetic peptide
SGGMPDL

SEQ ID NO: 100309 - protein, 7 aa, Artificial Sequence
  Description of Artificial Sequence: Synthetic peptide
SGGMPDM

SEQ ID NO: 100310 - protein, 7 aa, Artificial Sequence
  Description of Artificial Sequence: Synthetic peptide
SGGMPDQ

SEQ ID NO: 100311 - protein, 7 aa, Artificial Sequence
  Description of Artificial Sequence: Synthetic peptide
SGGMPDT

SEQ ID NO: 100312 - protein, 7 aa, Artificial Sequence
  Description of Artificial Sequence: Synthetic peptide
SGGMPDV

SEQ ID NO: 100313 - protein, 7 aa, Artificial Sequence
  Description of Artificial Sequence: Synthetic peptide
SGGMPDW

SEQ ID NO: 100314 - protein, 7 aa, Artificial Sequence
  Description of Artificial Sequence: Synthetic peptide
SGGMPDY

SEQ ID NO: 100315 - protein, 9 aa, Artificial Sequence
  Description of Artificial Sequence: Synthetic peptide
QQWDADPRT

SEQ ID NO: 100316 - protein, 9 aa, Artificial Sequence
  Description of Artificial Sequence: Synthetic peptide
QQWDAFPRT

SEQ ID NO: 100317 - protein, 9 aa, Artificial Sequence
  Description of Artificial Sequence: Synthetic peptide
QQWDAKPRT

SEQ ID NO: 100318 - protein, 9 aa, Artificial Sequence
  Description of Artificial Sequence: Synthetic peptide
QQWDANPRT

SEQ ID NO: 100319 - protein, 9 aa, Artificial Sequence
  Description of Artificial Sequence: Synthetic peptide
QQWDARPRT

SEQ ID NO: 100320 - protein, 9 aa, Artificial Sequence
  Description of Artificial Sequence: Synthetic peptide
QQWDASPRT

SEQ ID NO: 100321 - protein, 9 aa, Artificial Sequence
  Description of Artificial Sequence: Synthetic peptide
QQWDATPRT

SEQ ID NO: 100322 - protein, 9 aa, Artificial Sequence
  Description of Artificial Sequence: Synthetic peptide
QQWDGDPRT

SEQ ID NO: 100323 - protein, 9 aa, Artificial Sequence
  Description of Artificial Sequence: Synthetic peptide
QQWDGFPRT

SEQ ID NO: 100324 - protein, 9 aa, Artificial Sequence
  Description of Artificial Sequence: Synthetic peptide
QQWDGKPRT

SEQ ID NO: 100325 - protein, 9 aa, Artificial Sequence
  Description of Artificial Sequence: Synthetic peptide
QQWDGNPRT

SEQ ID NO: 100326 - protein, 9 aa, Artificial Sequence
  Description of Artificial Sequence: Synthetic peptide
QQWDGRPRT

SEQ ID NO: 100327 - protein, 9 aa, Artificial Sequence
  Description of Artificial Sequence: Synthetic peptide
QQWDGSPRT

SEQ ID NO: 100328 - protein, 9 aa, Artificial Sequence
  Description of Artificial Sequence: Synthetic peptide
QQWDGTPRT

SEQ ID NO: 100329 - protein, 9 aa, Artificial Sequence
  Description of Artificial Sequence: Synthetic peptide
QQWEADPRT

SEQ ID NO: 100330 - protein, 9 aa, Artificial Sequence
  Description of Artificial Sequence: Synthetic peptide
QQWEAFPRT

SEQ ID NO: 100331 - protein, 9 aa, Artificial Sequence
  Description of Artificial Sequence: Synthetic peptide
QQWEAKPRT

SEQ ID NO: 100332 - protein, 9 aa, Artificial Sequence
  Description of Artificial Sequence: Synthetic peptide
QQWEANPRT

SEQ ID NO: 100333 - protein, 9 aa, Artificial Sequence
  Description of Artificial Sequence: Synthetic peptide
QQWEARPRT

SEQ ID NO: 100334 - protein, 9 aa, Artificial Sequence
  Description of Artificial Sequence: Synthetic peptide
QQWEASPRT

SEQ ID NO: 100335 - protein, 9 aa, Artificial Sequence
  Description of Artificial Sequence: Synthetic peptide
QQWEATPRT

SEQ ID NO: 100336 - protein, 9 aa, Artificial Sequence
  Description of Artificial Sequence: Synthetic peptide
QQWEGDPRT

SEQ ID NO: 100337 - protein, 9 aa, Artificial Sequence
  Description of Artificial Sequence: Synthetic peptide
QQWEGFPRT

SEQ ID NO: 100338 - protein, 9 aa, Artificial Sequence
  Description of Artificial Sequence: Synthetic peptide
QQWEGKPRT

SEQ ID NO: 100339 - protein, 9 aa, Artificial Sequence
  Description of Artificial Sequence: Synthetic peptide
QQWEGNPRT

SEQ ID NO: 100340 - protein, 9 aa, Artificial Sequence
  Description of Artificial Sequence: Synthetic peptide
QQWEGRPRT

SEQ ID NO: 100341 - protein, 9 aa, Artificial Sequence
  Description of Artificial Sequence: Synthetic peptide
QQWEGSPRT

SEQ ID NO: 100342 - protein, 9 aa, Artificial Sequence
  Description of Artificial Sequence: Synthetic peptide
QQWEGTPRT

SEQ ID NO: 100343 - protein, 9 aa, Artificial Sequence
  Description of Artificial Sequence: Synthetic peptide
QQWHADPRT

SEQ ID NO: 100344 - protein, 9 aa, Artificial Sequence
  Description of Artificial Sequence: Synthetic peptide
QQWHAFPRT

SEQ ID NO: 100345 - protein, 9 aa, Artificial Sequence
  Description of Artificial Sequence: Synthetic peptide
QQWHAKPRT

SEQ ID NO: 100346 - protein, 9 aa, Artificial Sequence
  Description of Artificial Sequence: Synthetic peptide
QQWHANPRT

SEQ ID NO: 100347 - protein, 9 aa, Artificial Sequence
  Description of Artificial Sequence: Synthetic peptide
QQWHARPRT

SEQ ID NO: 100348 - protein, 9 aa, Artificial Sequence
  Description of Artificial Sequence: Synthetic peptide
QQWHASPRT

SEQ ID NO: 100349 - protein, 9 aa, Artificial Sequence
  Description of Artificial Sequence: Synthetic peptide
QQWHATPRT

SEQ ID NO: 100350 - protein, 9 aa, Artificial Sequence
  Description of Artificial Sequence: Synthetic peptide
QQWHGDPRT

SEQ ID NO: 100351 - protein, 9 aa, Artificial Sequence
  Description of Artificial Sequence: Synthetic peptide
QQWHGFPRT

SEQ ID NO: 100352 - protein, 9 aa, Artificial Sequence
  Description of Artificial Sequence: Synthetic peptide
QQWHGKPRT

SEQ ID NO: 100353 - protein, 9 aa, Artificial Sequence
  Description of Artificial Sequence: Synthetic peptide
QQWHGNPRT

SEQ ID NO: 100354 - protein, 9 aa, Artificial Sequence
  Description of Artificial Sequence: Synthetic peptide
QQWHGRPRT

SEQ ID NO: 100355 - protein, 9 aa, Artificial Sequence
  Description of Artificial Sequence: Synthetic peptide
QQWHGSPRT

SEQ ID NO: 100356 - protein, 9 aa, Artificial Sequence
  Description of Artificial Sequence: Synthetic peptide
QQWHGTPRT

SEQ ID NO: 100357 - protein, 9 aa, Artificial Sequence
  Description of Artificial Sequence: Synthetic peptide
QQWNADPRT

SEQ ID NO: 100358 - protein, 9 aa, Artificial Sequence
  Description of Artificial Sequence: Synthetic peptide
QQWNAFPRT

SEQ ID NO: 100359 - protein, 9 aa, Artificial Sequence
  Description of Artificial Sequence: Synthetic peptide
QQWNAKPRT

SEQ ID NO: 100360 - protein, 9 aa, Artificial Sequence
  Description of Artificial Sequence: Synthetic peptide
QQWNANPRT

SEQ ID NO: 100361 - protein, 9 aa, Artificial Sequence
  Description of Artificial Sequence: Synthetic peptide
QQWNARPRT

SEQ ID NO: 100362 - protein, 9 aa, Artificial Sequence
  Description of Artificial Sequence: Synthetic peptide
QQWNASPRT

SEQ ID NO: 100363 - protein, 9 aa, Artificial Sequence
  Description of Artificial Sequence: Synthetic peptide
QQWNATPRT

SEQ ID NO: 100364 - skipped

SEQ ID NO: 100365 - protein, 9 aa, Artificial Sequence
  Description of Artificial Sequence: Synthetic peptide
QQWNGFPRT

SEQ ID NO: 100366 - protein, 9 aa, Artificial Sequence
  Description of Artificial Sequence: Synthetic peptide
QQWNGKPRT

SEQ ID NO: 100367 - protein, 9 aa, Artificial Sequence
  Description of Artificial Sequence: Synthetic peptide
QQWNGNPRT

SEQ ID NO: 100368 - protein, 9 aa, Artificial Sequence
  Description of Artificial Sequence: Synthetic peptide
QQWNGRPRT

SEQ ID NO: 100369 - protein, 9 aa, Artificial Sequence
  Description of Artificial Sequence: Synthetic peptide
QQWNGSPRT

SEQ ID NO: 100370 - protein, 9 aa, Artificial Sequence
  Description of Artificial Sequence: Synthetic peptide
QQWNGTPRT

SEQ ID NO: 100371 - protein, 9 aa, Artificial Sequence
  Description of Artificial Sequence: Synthetic peptide
QQWQADPRT

SEQ ID NO: 100372 - protein, 9 aa, Artificial Sequence
  Description of Artificial Sequence: Synthetic peptide
QQWQAFPRT

SEQ ID NO: 100373 - protein, 9 aa, Artificial Sequence
  Description of Artificial Sequence: Synthetic peptide
QQWQAKPRT

SEQ ID NO: 100374 - protein, 9 aa, Artificial Sequence
  Description of Artificial Sequence: Synthetic peptide
QQWQANPRT

SEQ ID NO: 100375 - protein, 9 aa, Artificial Sequence
  Description of Artificial Sequence: Synthetic peptide
QQWQARPRT

SEQ ID NO: 100376 - protein, 9 aa, Artificial Sequence
  Description of Artificial Sequence: Synthetic peptide
QQWQASPRT

SEQ ID NO: 100377 - protein, 9 aa, Artificial Sequence
  Description of Artificial Sequence: Synthetic peptide
QQWQATPRT

SEQ ID NO: 100378 - protein, 9 aa, Artificial Sequence
  Description of Artificial Sequence: Synthetic peptide
QQWQGDPRT

SEQ ID NO: 100379 - protein, 9 aa, Artificial Sequence
  Description of Artificial Sequence: Synthetic peptide
QQWQGFPRT

SEQ ID NO: 100380 - protein, 9 aa, Artificial Sequence
  Description of Artificial Sequence: Synthetic peptide
QQWQGKPRT

SEQ ID NO: 100381 - protein, 9 aa, Artificial Sequence
  Description of Artificial Sequence: Synthetic peptide
QQWQGNPRT

SEQ ID NO: 100382 - protein, 9 aa, Artificial Sequence
  Description of Artificial Sequence: Synthetic peptide
QQWQGRPRT

SEQ ID NO: 100383 - protein, 9 aa, Artificial Sequence
  Description of Artificial Sequence: Synthetic peptide
QQWQGSPRT

SEQ ID NO: 100384 - protein, 9 aa, Artificial Sequence
  Description of Artificial Sequence: Synthetic peptide
QQWQGTPRT

SEQ ID NO: 100385 - protein, 9 aa, Artificial Sequence
  Description of Artificial Sequence: Synthetic peptide
QQWSADPRT

SEQ ID NO: 100386 - protein, 9 aa, Artificial Sequence
  Description of Artificial Sequence: Synthetic peptide
QQWSAFPRT

SEQ ID NO: 100387 - protein, 9 aa, Artificial Sequence
  Description of Artificial Sequence: Synthetic peptide
QQWSAKPRT

SEQ ID NO: 100388 - protein, 9 aa, Artificial Sequence
  Description of Artificial Sequence: Synthetic peptide
QQWSANPRT

SEQ ID NO: 100389 - protein, 9 aa, Artificial Sequence
  Description of Artificial Sequence: Synthetic peptide
QQWSARPRT

SEQ ID NO: 100390 - protein, 9 aa, Artificial Sequence
  Description of Artificial Sequence: Synthetic peptide
QQWSASPRT

SEQ ID NO: 100391 - protein, 9 aa, Artificial Sequence
  Description of Artificial Sequence: Synthetic peptide
QQWSATPRT

SEQ ID NO: 100392 - protein, 9 aa, Artificial Sequence
  Description of Artificial Sequence: Synthetic peptide
QQWSGDPRT

SEQ ID NO: 100393 - protein, 9 aa, Artificial Sequence
  Description of Artificial Sequence: Synthetic peptide
QQWSGFPRT

SEQ ID NO: 100394 - protein, 9 aa, Artificial Sequence
  Description of Artificial Sequence: Synthetic peptide
QQWSGKPRT

SEQ ID NO: 100395 - protein, 9 aa, Artificial Sequence
  Description of Artificial Sequence: Synthetic peptide
QQWSGNPRT

SEQ ID NO: 100396 - protein, 9 aa, Artificial Sequence
  Description of Artificial Sequence: Synthetic peptide
QQWSGRPRT

SEQ ID NO: 100397 - protein, 9 aa, Artificial Sequence
  Description of Artificial Sequence: Synthetic peptide
QQWSGSPRT

SEQ ID NO: 100398 - protein, 9 aa, Artificial Sequence
  Description of Artificial Sequence: Synthetic peptide
QQWSGTPRT

SEQ ID NO: 100399 - protein, 9 aa, Artificial Sequence
  Description of Artificial Sequence: Synthetic peptide
QQWDADPRT

SEQ ID NO: 100400 - protein, 9 aa, Artificial Sequence
  Description of Artificial Sequence: Synthetic peptide
NQWDAFPRT

SEQ ID NO: 100401 - protein, 9 aa, Artificial Sequence
  Description of Artificial Sequence: Synthetic peptide
NQWDAKPRT

SEQ ID NO: 100402 - protein, 9 aa, Artificial Sequence
  Description of Artificial Sequence: Synthetic peptide
NQWDANPRT

SEQ ID NO: 100403 - protein, 9 aa, Artificial Sequence
  Description of Artificial Sequence: Synthetic peptide
NQWDARPRT

SEQ ID NO: 100404 - protein, 9 aa, Artificial Sequence
  Description of Artificial Sequence: Synthetic peptide
NQWDASPRT

SEQ ID NO: 100405 - protein, 9 aa, Artificial Sequence
  Description of Artificial Sequence: Synthetic peptide
NQWDATPRT

SEQ ID NO: 100406 - protein, 9 aa, Artificial Sequence
  Description of Artificial Sequence: Synthetic peptide
NQWDGDPRT

SEQ ID NO: 100407 - protein, 9 aa, Artificial Sequence
  Description of Artificial Sequence: Synthetic peptide
NQWDGFPRT

SEQ ID NO: 100408 - protein, 9 aa, Artificial Sequence
  Description of Artificial Sequence: Synthetic peptide
NQWDGKPRT

SEQ ID NO: 100409 - protein, 9 aa, Artificial Sequence
  Description of Artificial Sequence: Synthetic peptide
NQWDGNPRT

SEQ ID NO: 100410 - protein, 9 aa, Artificial Sequence
  Description of Artificial Sequence: Synthetic peptide
NQWDGRPRT

SEQ ID NO: 100411 - protein, 9 aa, Artificial Sequence
  Description of Artificial Sequence: Synthetic peptide
NQWDGSPRT

SEQ ID NO: 100412 - protein, 9 aa, Artificial Sequence
  Description of Artificial Sequence: Synthetic peptide
NQWDGTPRT

SEQ ID NO: 100413 - protein, 9 aa, Artificial Sequence
  Description of Artificial Sequence: Synthetic peptide
NQWEADPRT

SEQ ID NO: 100414 - protein, 9 aa, Artificial Sequence
  Description of Artificial Sequence: Synthetic peptide
NQWEAFPRT

SEQ ID NO: 100415 - protein, 9 aa, Artificial Sequence
  Description of Artificial Sequence: Synthetic peptide
NQWEAKPRT

SEQ ID NO: 100416 - protein, 9 aa, Artificial Sequence
  Description of Artificial Sequence: Synthetic peptide
NQWEANPRT

SEQ ID NO: 100417 - protein, 9 aa, Artificial Sequence
  Description of Artificial Sequence: Synthetic peptide
NQWEARPRT

SEQ ID NO: 100418 - protein, 9 aa, Artificial Sequence
  Description of Artificial Sequence: Synthetic peptide
NQWEASPRT

SEQ ID NO: 100419 - protein, 9 aa, Artificial Sequence
  Description of Artificial Sequence: Synthetic peptide
NQWEATPRT

SEQ ID NO: 100420 - protein, 9 aa, Artificial Sequence
  Description of Artificial Sequence: Synthetic peptide
NQWEGDPRT

SEQ ID NO: 100421 - protein, 9 aa, Artificial Sequence
  Description of Artificial Sequence: Synthetic peptide
NQWEGFPRT

SEQ ID NO: 100422 - protein, 9 aa, Artificial Sequence
  Description of Artificial Sequence: Synthetic peptide
NQWEGKPRT

SEQ ID NO: 100423 - protein, 9 aa, Artificial Sequence
  Description of Artificial Sequence: Synthetic peptide
NQWEGNPRT

SEQ ID NO: 100424 - protein, 9 aa, Artificial Sequence
  Description of Artificial Sequence: Synthetic peptide
NQWEGRPRT

SEQ ID NO: 100425 - protein, 9 aa, Artificial Sequence
  Description of Artificial Sequence: Synthetic peptide
NQWEGSPRT

SEQ ID NO: 100426 - protein, 9 aa, Artificial Sequence
  Description of Artificial Sequence: Synthetic peptide
NQWEGTPRT

SEQ ID NO: 100427 - protein, 9 aa, Artificial Sequence
  Description of Artificial Sequence: Synthetic peptide
NQWHADPRT

SEQ ID NO: 100428 - protein, 9 aa, Artificial Sequence
  Description of Artificial Sequence: Synthetic peptide
NQWHAFPRT

SEQ ID NO: 100429 - protein, 9 aa, Artificial Sequence
  Description of Artificial Sequence: Synthetic peptide
NQWHAKPRT

SEQ ID NO: 100430 - protein, 9 aa, Artificial Sequence
  Description of Artificial Sequence: Synthetic peptide
NQWHANPRT

SEQ ID NO: 100431 - protein, 9 aa, Artificial Sequence
  Description of Artificial Sequence: Synthetic peptide
NQWHARPRT

SEQ ID NO: 100432 - protein, 9 aa, Artificial Sequence
  Description of Artificial Sequence: Synthetic peptide
NQWHASPRT

SEQ ID NO: 100433 - protein, 9 aa, Artificial Sequence
  Description of Artificial Sequence: Synthetic peptide
NQWHATPRT

SEQ ID NO: 100434 - protein, 9 aa, Artificial Sequence
  Description of Artificial Sequence: Synthetic peptide
NQWHGDPRT

SEQ ID NO: 100435 - protein, 9 aa, Artificial Sequence
  Description of Artificial Sequence: Synthetic peptide
NQWHGFPRT

SEQ ID NO: 100436 - protein, 9 aa, Artificial Sequence
  Description of Artificial Sequence: Synthetic peptide
NQWHGKPRT

SEQ ID NO: 100437 - protein, 9 aa, Artificial Sequence
  Description of Artificial Sequence: Synthetic peptide
NQWHGNPRT

SEQ ID NO: 100438 - protein, 9 aa, Artificial Sequence
  Description of Artificial Sequence: Synthetic peptide
NQWHGRPRT

SEQ ID NO: 100439 - protein, 9 aa, Artificial Sequence
  Description of Artificial Sequence: Synthetic peptide
NQWHGSPRT

SEQ ID NO: 100440 - protein, 9 aa, Artificial Sequence
  Description of Artificial Sequence: Synthetic peptide
NQWHGTPRT

SEQ ID NO: 100441 - protein, 9 aa, Artificial Sequence
  Description of Artificial Sequence: Synthetic peptide
NQWNADPRT

SEQ ID NO: 100442 - protein, 9 aa, Artificial Sequence
  Description of Artificial Sequence: Synthetic peptide
NQWNAFPRT

SEQ ID NO: 100443 - protein, 9 aa, Artificial Sequence
  Description of Artificial Sequence: Synthetic peptide
NQWNAKPRT

SEQ ID NO: 100444 - protein, 9 aa, Artificial Sequence
  Description of Artificial Sequence: Synthetic peptide
NQWNANPRT

SEQ ID NO: 100445 - protein, 9 aa, Artificial Sequence
  Description of Artificial Sequence: Synthetic peptide
NQWNARPRT

SEQ ID NO: 100446 - protein, 9 aa, Artificial Sequence
  Description of Artificial Sequence: Synthetic peptide
NQWNASPRT

SEQ ID NO: 100447 - protein, 9 aa, Artificial Sequence
  Description of Artificial Sequence: Synthetic peptide
NQWNATPRT

SEQ ID NO: 100448 - protein, 9 aa, Artificial Sequence
  Description of Artificial Sequence: Synthetic peptide
NQWNGDPRT

SEQ ID NO: 100449 - protein, 9 aa, Artificial Sequence
  Description of Artificial Sequence: Synthetic peptide
NQWNGFPRT

SEQ ID NO: 100450 - protein, 9 aa, Artificial Sequence
  Description of Artificial Sequence: Synthetic peptide
NQWNGKPRT

SEQ ID NO: 100451 - protein, 9 aa, Artificial Sequence
  Description of Artificial Sequence: Synthetic peptide
NQWNGNPRT

SEQ ID NO: 100452 - protein, 9 aa, Artificial Sequence
  Description of Artificial Sequence: Synthetic peptide
NQWNGRPRT

SEQ ID NO: 100453 - protein, 9 aa, Artificial Sequence
  Description of Artificial Sequence: Synthetic peptide
NQWNGSPRT

SEQ ID NO: 100454 - protein, 9 aa, Artificial Sequence
  Description of Artificial Sequence: Synthetic peptide
NQWNGTPRT

SEQ ID NO: 100455 - protein, 9 aa, Artificial Sequence
  Description of Artificial Sequence: Synthetic peptide
NQWQADPRT

SEQ ID NO: 100456 - protein, 9 aa, Artificial Sequence
  Description of Artificial Sequence: Synthetic peptide
NQWQAFPRT

SEQ ID NO: 100457 - protein, 9 aa, Artificial Sequence
  Description of Artificial Sequence: Synthetic peptide
NQWQAKPRT

SEQ ID NO: 100458 - protein, 9 aa, Artificial Sequence
  Description of Artificial Sequence: Synthetic peptide
NQWQANPRT

SEQ ID NO: 100459 - protein, 9 aa, Artificial Sequence
  Description of Artificial Sequence: Synthetic peptide
NQWQARPRT

SEQ ID NO: 100460 - protein, 9 aa, Artificial Sequence
  Description of Artificial Sequence: Synthetic peptide
NQWQASPRT

SEQ ID NO: 100461 - protein, 9 aa, Artificial Sequence
  Description of Artificial Sequence: Synthetic peptide
NQWQATPRT

SEQ ID NO: 100462 - protein, 9 aa, Artificial Sequence
  Description of Artificial Sequence: Synthetic peptide
NQWQGDPRT

SEQ ID NO: 100463 - protein, 9 aa, Artificial Sequence
  Description of Artificial Sequence: Synthetic peptide
NQWQGFPRT

SEQ ID NO: 100464 - protein, 9 aa, Artificial Sequence
  Description of Artificial Sequence: Synthetic peptide
NQWQGKPRT

SEQ ID NO: 100465 - protein, 9 aa, Artificial Sequence
  Description of Artificial Sequence: Synthetic peptide
NQWQGNPRT

SEQ ID NO: 100466 - protein, 9 aa, Artificial Sequence
  Description of Artificial Sequence: Synthetic peptide
NQWQGRPRT

SEQ ID NO: 100467 - protein, 9 aa, Artificial Sequence
  Description of Artificial Sequence: Synthetic peptide
NQWQGSPRT

SEQ ID NO: 100468 - protein, 9 aa, Artificial Sequence
  Description of Artificial Sequence: Synthetic peptide
NQWQGTPRT

SEQ ID NO: 100469 - protein, 9 aa, Artificial Sequence
  Description of Artificial Sequence: Synthetic peptide
NQWSADPRT

SEQ ID NO: 100470 - protein, 9 aa, Artificial Sequence
  Description of Artificial Sequence: Synthetic peptide
NQWSAFPRT

SEQ ID NO: 100471 - protein, 9 aa, Artificial Sequence
  Description of Artificial Sequence: Synthetic peptide
NQWSAKPRT

SEQ ID NO: 100472 - protein, 9 aa, Artificial Sequence
  Description of Artificial Sequence: Synthetic peptide
NQWSANPRT

SEQ ID NO: 100473 - protein, 9 aa, Artificial Sequence
  Description of Artificial Sequence: Synthetic peptide
NQWSARPRT

SEQ ID NO: 100474 - protein, 9 aa, Artificial Sequence
  Description of Artificial Sequence: Synthetic peptide
NQWSASPRT

SEQ ID NO: 100475 - protein, 9 aa, Artificial Sequence
  Description of Artificial Sequence: Synthetic peptide
NQWSATPRT

SEQ ID NO: 100476 - protein, 9 aa, Artificial Sequence
  Description of Artificial Sequence: Synthetic peptide
NQWSGDPRT

SEQ ID NO: 100477 - protein, 9 aa, Artificial Sequence
  Description of Artificial Sequence: Synthetic peptide
NQWSGFPRT

SEQ ID NO: 100478 - protein, 9 aa, Artificial Sequence
  Description of Artificial Sequence: Synthetic peptide
NQWSGKPRT

SEQ ID NO: 100479 - protein, 9 aa, Artificial Sequence
  Description of Artificial Sequence: Synthetic peptide
NQWSGNPRT

SEQ ID NO: 100480 - protein, 9 aa, Artificial Sequence
  Description of Artificial Sequence: Synthetic peptide
NQWSGRPRT

SEQ ID NO: 100481 - protein, 9 aa, Artificial Sequence
  Description of Artificial Sequence: Synthetic peptide
NQWSGSPRT

SEQ ID NO: 100482 - protein, 9 aa, Artificial Sequence
  Description of Artificial Sequence: Synthetic peptide
NQWSGTPRT

SEQ ID NO: 100483-364099 - skipped (263617 entries)

SEQ ID NO: 364100 - protein, 9 aa, Artificial Sequence
  Description of Artificial Sequence: Synthetic peptide
QQWNGDPRT

SEQ ID NO: 364101 - DNA, 19 bp, Artificial Sequence
  Description of Artificial Sequence: Synthetic primer
tgcttctggaagtgaaagt

SEQ ID NO: 364102 - DNA, 20 bp, Artificial Sequence
  Description of Artificial Sequence: Synthetic primer
gtcatcatcgctttcatgtg

SEQ ID NO: 364103 - DNA, 19 bp, Artificial Sequence
  Description of Artificial Sequence: Synthetic primer
ctggatgctcacaggtttg

SEQ ID NO: 364104 - DNA, 21 bp, Artificial Sequence
  Description of Artificial Sequence: Synthetic primer
agtccctgttctgaatcctct

SEQ ID NO: 364105 - DNA, 23 bp, Artificial Sequence
  Description of Artificial Sequence: Synthetic primer
ctttttgtctcctacctcagagg

SEQ ID NO: 364106 - DNA, 20 bp, Artificial Sequence
  Description of Artificial Sequence: Synthetic primer
ataagaacctctgctgcaca

SEQ ID NO: 364107 - DNA, 20 bp, Artificial Sequence
  Description of Artificial Sequence: Synthetic primer
ttgggaatcagataggtgca

SEQ ID NO: 364108 - DNA, 20 bp, Artificial Sequence
  Description of Artificial Sequence: Synthetic primer
aaacaggaacaggctggttc

SEQ ID NO: 364109 - DNA, 18 bp, Artificial Sequence
  Description of Artificial Sequence: Synthetic primer
ccaagccagtcccagtag

SEQ ID NO: 364110 - DNA, 20 bp, Artificial Sequence
  Description of Artificial Sequence: Synthetic primer
ttggcaaggtttcaggtttg

SEQ ID NO: 364111 - DNA, 21 bp, Artificial Sequence
  Description of Artificial Sequence: Synthetic primer
tgaggttcaaaatgacagagg

SEQ ID NO: 364112 - DNA, 23 bp, Artificial Sequence
  Description of Artificial Sequence: Synthetic primer
ttttcaatgcacagatttaagga

SEQ ID NO: 364113 - DNA, 24 bp, Artificial Sequence
  Description of Artificial Sequence: Synthetic primer
cctaaggagacttttagttctaag

SEQ ID NO: 364114 - DNA, 19 bp, Artificial Sequence
  Description of Artificial Sequence: Synthetic primer
atggggaacgttgtggcag

SEQ ID NO: 364115 - DNA, 18 bp, Artificial Sequence
  Description of Artificial Sequence: Synthetic primer
cggcagccagacaggtaa

SEQ ID NO: 364116 - DNA, 20 bp, Artificial Sequence
  Description of Artificial Sequence: Synthetic primer
acagaggcagtatagcacag

SEQ ID NO: 364117 - DNA, 20 bp, Artificial Sequence
  Description of Artificial Sequence: Synthetic primer
atcaagtcacaactgccaga

SEQ ID NO: 364118 - DNA, 20 bp, Artificial Sequence
  Description of Artificial Sequence: Synthetic primer
gctctgccttcacatttctg

SEQ ID NO: 364119 - DNA, 21 bp, Artificial Sequence
  Description of Artificial Sequence: Synthetic primer
aatgaccagatccaaatgagg

SEQ ID NO: 364120 - DNA, 19 bp, Artificial Sequence
  Description of Artificial Sequence: Synthetic primer
gtcccctggtctccctgtc

SEQ ID NO: 364121 - DNA, 12 bp, Artificial Sequence
  Description of Artificial Sequence: Synthetic probe
tgcagattggga

SEQ ID NO: 364122 - DNA, 14 bp, Artificial Sequence
  Description of Artificial Sequence: Synthetic probe
atttggaaagggaa

SEQ ID NO: 364123 - DNA, 14 bp, Artificial Sequence
  Description of Artificial Sequence: Synthetic probe
agaatacacaagga

SEQ ID NO: 364124 - DNA, 11 bp, Artificial Sequence
  Description of Artificial Sequence: Synthetic probe
tcctagcgata

SEQ ID NO: 364125 - DNA, 12 bp, Artificial Sequence
  Description of Artificial Sequence: Synthetic probe
cgggcacagctc

SEQ ID NO: 364126 - DNA, 14 bp, Artificial Sequence
  Description of Artificial Sequence: Synthetic probe
agtgattgactcaa

SEQ ID NO: 364127 - DNA, 14 bp, Artificial Sequence
  Description of Artificial Sequence: Synthetic probe
ccattaaagtcaga

SEQ ID NO: 364128 - DNA, 13 bp, Artificial Sequence
  Description of Artificial Sequence: Synthetic probe
tagttaagcccat

SEQ ID NO: 364129 - DNA, 12 bp, Artificial Sequence
  Description of Artificial Sequence: Synthetic probe
agggaccgctga

SEQ ID NO: 364130 - DNA, 13 bp, Artificial Sequence
  Description of Artificial Sequence: Synthetic probe
cggtgcttcgtcc

SEQ ID NO: 364131 - DNA, 12 bp, Artificial Sequence
  Description of Artificial Sequence: Synthetic probe
tgcaggttggga

SEQ ID NO: 364132 - DNA, 14 bp, Artificial Sequence
  Description of Artificial Sequence: Synthetic probe
atttggcaagggaa

SEQ ID NO: 364133 - DNA, 12 bp, Artificial Sequence
  Description of Artificial Sequence: Synthetic probe
tagaatccacaa

SEQ ID NO: 364134 - DNA, 11 bp, Artificial Sequence
  Description of Artificial Sequence: Synthetic probe
tcctagggata

SEQ ID NO: 364135 - DNA, 13 bp, Artificial Sequence
  Description of Artificial Sequence: Synthetic probe
tcgggctcagctc

SEQ ID NO: 364136 - DNA, 14 bp, Artificial Sequence
  Description of Artificial Sequence: Synthetic probe
agtgattggctcaa

SEQ ID NO: 364137 - DNA, 15 bp, Artificial Sequence
  Description of Artificial Sequence: Synthetic probe
accattaaattcaga

SEQ ID NO: 364138 - DNA, 12 bp, Artificial Sequence
  Description of Artificial Sequence: Synthetic probe
tagttaggccca

SEQ ID NO: 364139 - DNA, 12 bp, Artificial Sequence
  Description of Artificial Sequence: Synthetic probe
agggaccactga

SEQ ID NO: 364140 - DNA, 13 bp, Artificial Sequence
  Description of Artificial Sequence: Synthetic probe
cggtgcctcgtcc

SEQ ID NO: 364141 - DNA, 1001 bp, Homo sapiens
tatccaccagccttggcctcccaaagtgctaggattacaggcatgagccaccacgcatggcctgtcttttcttcttggtcattttcgctaaaggtttgtcaattttgttgatcttttttgttgctgatctctattgttttcccattctgtttcatttatttccattttaacctttgtttccttttttctgctggtttgggtttaatttgctctttttttcccctaatttttcaaggtatacagttaagttattgatttgagatctcttttttcttttctttttttttttttttttttttttttggttgctgttgagatggagtctccctctgtcacccagactggagtgcagtggcatgatctcagctcactgcagcctccgccgcccaggcgattctcctgcctcagcctcctgagtagacgtttcccggccaaggtgtttctttttgaatgtaagcatttacagctacagatttccctctaaacactgctttcactgcrttccataagattgttttttgttgttgttttgttgtttgagacacagtctcactctgttgccgtttggagagcagcgatgcgatcatagctctgtagccttgagctcctggactcaatcagtcctcctgcctcagcctcccaagtagctgggactacaggtgtacaccactgcacctaactaatttcttttataagtttttgcagaggccaggcacagtggctcacacctgtaatcccagcactttgggaggccaaggtgggtggatcacctaaggtcaggagttcgagaccagcctggccgacagggagaaaccccatctctactaaaaatacaaaaattagctgggcgtggtggcaggtgcctgtaatcccagctactcaggaggctgaggcaggagaatcgcttgaacctgggaggcagaggttgcagtgagccaggatcacaccattgcactccagcctgggtaacaaaagcaaaactccatctcaagaaaagaaaa

SEQ ID NO: 364142 - DNA, 1001 bp, Homo sapiens
catctggctacctcggcctcccaaagtgctgggattacaggcgtgagccaccaagcccagcctaacgttacatttctttctttctttttctttccttttttttttttttgagacagactctcactctgctgcccaggctggagtgcagtggcatgatcttgtctcactacaacctctgtctcccaggttcaagcaattctcgtgcctcagcctccccagtagctaggattacaggcacccaccaccacccccagctaactttttatattattagtagagacagggtttcaccatgttggctgggctggtcttgaactcctgacctgaagtgatccaccctcctcaggcttccaaagtgctgggattacaggcatgagccatggtgcccggctatatttctaagtttattttgcttcatataccaggaaccgtagtttgtttcacatgtggtcttgaaaatagtttgttctgttctgattataagtaacatgtgtttattgsttttttttaaaaaagggtaaatatccaggtgcagtggcatgtgcttgtagtcccagctactcaggaggctgaggccggaggaagcttttgagcccaggcatttgagactgtagtgagctgtgattgttccactgcattctaacctgggtgatagagcaagaccctgtctcaaaaataaaatacaattaaattaaatttaaaaattaaaaaattgataaatatagaaaaaatgtgaaaaccaaaggggaacgcctcccactaccagagatcatttctattttcattctggagaatttccttctagtttttttttaaaacgcataaatatgggaaatacacaattatgggaaatatacaacttcccataatgagttaacacaccatttacgattttgtgtcctgctagtctgtcattatgtcattagcgtttatcccttgcataaaatgcttctcagattactaaatggcaacatactataatattgaactttgtggatatc

What is claimed:

1. A method of treating moderately to severely active Crohn's disease or ulcerative colitis in a subject, the method comprising: administering a therapeutically effective amount of an inhibitor of Tumor necrosis factor-like cytokine 1A (TL1A) activity or expression to a subject with moderately to severely active Crohn's disease or ulcerative colitis that tested positive with a test for predicting a positive therapeutic response to the inhibitor of the TL1A activity or expression with a positive predictive value of at least about 70% based, at least in part, on a presence of a combination of genotypes identified in a biological sample obtained from the subject,
wherein the inhibitor of TL1A activity or expression is a protein.

2. The method of claim 1, wherein the combination of genotypes comprises three or more polymorphisms.

3. The method of claim 1, wherein the positive predictive value is at least about 75%.

4. The method of claim 1, wherein the test predicts the positive therapeutic response to the therapeutically effective amount of the inhibitor of the TL1A activity or expression with a specificity of at least about 70%.

5. The method of claim 2, wherein the three or more polymorphisms comprise rs6478109, rs16901748, and rs2297437, or a proxy polymorphism in linkage disequilibrium therewith as determined with an $R^2$ of at least 0.85.

6. The method of claim 2, wherein the three or more polymorphisms comprise rs6478109, rs2070557, and rs7935393, or a proxy polymorphism in linkage disequilibrium therewith as determined with an $R^2$ of at least 0.85.

7. The method of claim 2, wherein the three or more polymorphisms comprise rs6478109, rs7278257, and rs7935393, or a proxy polymorphism in linkage disequilibrium therewith as determined with an $R^2$ of at least 0.85.

8. The method of claim 2, wherein the three or more polymorphisms comprise rs6478109, rs9806914, and rs1892231, or a proxy polymorphism in linkage disequilibrium therewith as determined with an $R^2$ of at least 0.85.

9. The method of claim 2, wherein the three or more polymorphisms comprise rs6478109, rs7278257, and rs16901748, or a proxy polymorphism in linkage disequilibrium therewith as determined with an $R^2$ of at least 0.85.

10. The method of claim 9, wherein the proxy polymorphism for rs7278257 is rs56124762.

11. The method of claim 1, wherein the combination of genotypes comprises a combination of single-nucleotide variants.

12. The method of claim 1, wherein the inhibitor of TL1A activity or expression comprises an anti-TL1A antibody or antigen-binding fragment thereof.

13. A method of treating moderately to severely active Crohn's disease or ulcerative colitis in a subject, the method comprising: administering a therapeutically effective amount of an inhibitor of Tumor necrosis factor-like cytokine 1A (TL1A) activity or expression to a subject selected for treatment based on an allele combination predictive of a positive therapeutic response to the inhibitor of TL1A activity or expression with a positive predictive value of at least about 70%, wherein the allele combination is detected in a biological sample obtained from the subject, and wherein the inhibitor of TL1A activity or expression is a protein.

14. The method of claim 13, wherein the allele combination comprises at least three variant alleles at three or more polymorphisms.

15. The method of claim 13, wherein the positive predictive value is at least about 75%.

16. The method of claim 13, wherein the allele combination is predictive of the positive therapeutic response to the therapeutically effective amount of the inhibitor of the TL1A activity or expression with a specificity of at least about 70%.

17. The method of claim 14, wherein the three or more polymorphisms comprise rs6478109, rs16901748, and rs2297437, or a proxy polymorphism in linkage disequilibrium therewith as determined with an $R^2$ of at least 0.85.

18. The method of claim 14, wherein the three or more polymorphisms comprise rs6478109, rs2070557, and rs7935393, or a proxy polymorphism in linkage disequilibrium therewith as determined with an $R^2$ of at least 0.85.

19. The method of claim 14, wherein the three or more polymorphisms comprise rs6478109, rs7278257, and rs7935393, or a proxy polymorphism in linkage disequilibrium therewith as determined with an $R^2$ of at least 0.85.

20. The method of claim 14, wherein the three or more polymorphisms comprise rs6478109, rs9806914, and rs1892231, or a proxy polymorphism in linkage disequilibrium therewith as determined with an R² of at least 0.85.

21. The method of claim 14, wherein the three or more polymorphisms comprise rs6478109, rs7278257, and rs16901748, or a proxy polymorphism in linkage disequilibrium therewith as determined with an R² of at least 0.85.

22. The method of claim 21, wherein the proxy polymorphism for rs7278257 is rs56124762.

23. The method of claim 10, wherein the combination of genotypes comprises a combination of single-nucleotide variants.

24. The method of claim 13, wherein the allele combination comprises a combination of single-nucleotide variants.

25. The method of claim 10, wherein the inhibitor of TL1A activity or expression comprises an anti-TL1A antibody or antigen-binding fragment thereof.

26. The method of claim 13, wherein the inhibitor of TL1A activity or expression comprises an anti-TL1A antibody or antigen-binding fragment thereof.

27. A method of treating moderately to severely active Crohn's disease or ulcerative colitis in a subject, the method comprising: administering a therapeutically effective amount of an inhibitor of Tumor necrosis factor-like cytokine 1A (TL1A) activity or expression to a subject with moderately to severely active Crohn's disease or ulcerative colitis that tested positive with a test for predicting a positive therapeutic response to the inhibitor of the TL1A activity or expression with a positive predictive value of at least about 70% based, at least in part, on a presence of a combination of genotypes identified in a biological sample obtained from the subject,
wherein the inhibitor of TL1A activity or expression is a nucleic acid molecule.

28. The method of claim 27, wherein the combination of genotypes comprises three or more polymorphisms.

29. The method of claim 27, wherein the positive predictive value is at least about 75%.

30. The method of claim 27, wherein the test predicts the positive therapeutic response to the therapeutically effective amount of the inhibitor of the TL1A activity or expression with a specificity of at least about 70%.

31. The method of claim 28, wherein the three or more polymorphisms comprise rs6478109, rs16901748, and rs2297437, or a proxy polymorphism in linkage disequilibrium therewith as determined with an R² of at least 0.85.

32. The method of claim 28, wherein the three or more polymorphisms comprise rs6478109, rs2070557, and rs7935393, or a proxy polymorphism in linkage disequilibrium therewith as determined with an R² of at least 0.85.

33. The method of claim 28, wherein the three or more polymorphisms comprise rs6478109, rs7278257, and rs7935393, or a proxy polymorphism in linkage disequilibrium therewith as determined with an R² of at least 0.85.

34. The method of claim 28, wherein the three or more polymorphisms comprise rs6478109, rs9806914, and rs1892231, or a proxy polymorphism in linkage disequilibrium therewith as determined with an R² of at least 0.85.

35. The method of claim 28, wherein the three or more polymorphisms comprise rs6478109, rs7278257, and rs16901748, or a proxy polymorphism in linkage disequilibrium therewith as determined with an R² of at least 0.85.

36. The method of claim 35, wherein the proxy polymorphism for rs7278257 is rs56124762.

37. The method of claim 27, wherein the combination of genotypes comprises a combination of single-nucleotide variants.

38. The method of claim 36, wherein the combination of genotypes comprises a combination of single-nucleotide variants.

39. The method of claim 27, wherein the inhibitor of TL1A activity or expression comprises an siRNA.

40. The method of claim 36, wherein the inhibitor of TL1A activity or expression comprises an siRNA.

41. A method of treating moderately to severely active Crohn's disease or ulcerative colitis in a subject, the method comprising: administering a therapeutically effective amount of an inhibitor of Tumor necrosis factor-like cytokine 1A (TL1A) activity or expression to a subject selected for treatment based on an allele combination predictive of a positive therapeutic response to the inhibitor of TL1A activity or expression with a positive predictive value of at least about 70%, wherein the allele combination is detected in a biological sample obtained from the subject, and wherein the inhibitor of TL1A activity or expression is a nucleic acid molecule.

42. The method of claim 41, wherein the allele combination comprises at least three variant alleles at three or more polymorphisms.

43. The method of claim 41, wherein the positive predictive value is at least about 75%.

44. The method of claim 41, wherein the allele combination is predictive of the positive therapeutic response to the therapeutically effective amount of the inhibitor of the TL1A activity or expression with a specificity of at least about 70%.

45. The method of claim 42, wherein the three or more polymorphisms comprise rs6478109, rs16901748, and rs2297437, or a proxy polymorphism in linkage disequilibrium therewith as determined with an R² of at least 0.85.

46. The method of claim 42, wherein the three or more polymorphisms comprise rs6478109, rs2070557, and rs7935393, or a proxy polymorphism in linkage disequilibrium therewith as determined with an R² of at least 0.85.

47. The method of claim 42, wherein the three or more polymorphisms comprise rs6478109, rs7278257, and rs7935393, or a proxy polymorphism in linkage disequilibrium therewith as determined with an R² of at least 0.85.

48. The method of claim 42, wherein the three or more polymorphisms comprise rs6478109, rs9806914, and rs1892231, or a proxy polymorphism in linkage disequilibrium therewith as determined with an R² of at least 0.85.

49. The method of claim 42, wherein the three or more polymorphisms comprise rs6478109, rs7278257, and rs16901748, or a proxy polymorphism in linkage disequilibrium therewith as determined with an R² of at least 0.85.

50. The method of claim 49, wherein the proxy polymorphism for rs7278257 is rs56124762.

51. The method of claim 41, wherein the allele combination comprises a combination of single-nucleotide variants.

52. The method of claim 41, wherein the inhibitor of TL1A activity or expression comprises an siRNA.

53. The method of claim 50, wherein the inhibitor of TL1A activity or expression comprises an siRNA.

* * * * *